United States Patent 12,642,819 (COMPOSITIONS AND METHODS FOR TREATING INFLAMMATORY BOWEL DISEASE) - sequence listing, part 57

SEQ ID NO: 25 - DNA, 2691647 bp, Bifidobacterium longum (residues 1-1,345,824 of 2,691,647)
  modified_base (207662)..(207757): a, c, t, g, unknown or other
  modified_base (1033488)..(1033583): a, c, t, g, unknown or other
  modified_base (1407334)..(1407431): a, c, t, g, unknown or other
  modified_base (2217268)..(2217313): a, c, t, g, unknown or other
  modified_base (2223078)..(2223187): a, c, t, g, unknown or other
  modified_base (2223724)..(2223826): a, c, t, g, unknown or other
  modified_base (2224206)..(2224288): a, c, t, g, unknown or other
  modified_base (2224598)..(2224607): a, c, t, g, unknown or other
  modified_base (2225123)..(2225132): a, c, t, g, unknown or other
  modified_base (2225858)..(2225867): a, c, t, g, unknown or other
  modified_base (2239052)..(2239088): a, c, t, g, unknown or other
  modified_base (2239397)..(2239406): a, c, t, g, unknown or other
  modified_base (2239817)..(2240013): a, c, t, g, unknown or other
  modified_base (2241715)..(2241724): a, c, t, g, unknown or other
  modified_base (2244427)..(2244465): a, c, t, g, unknown or other
  modified_base (2246458)..(2246467): a, c, t, g, unknown or other
  modified_base (2246898)..(2246933): a, c, t, g, unknown or other
  modified_base (2266535)..(2266549): a, c, t, g, unknown or other
  modified_base (2267960)..(2268090): a, c, t, g, unknown or other
  modified_base (2269203)..(2269317): a, c, t, g, unknown or other
  modified_base (2270250)..(2270259): a, c, t, g, unknown or other
  modified_base (2270721)..(2270730): a, c, t, g, unknown or other
  modified_base (2271208)..(2271292): a, c, t, g, unknown or other
  modified_base (2275527)..(2275600): a, c, t, g, unknown or other
  modified_base (2276137)..(2276224): a, c, t, g, unknown or other
  modified_base (2277302)..(2277366): a, c, t, g, unknown or other
  modified_base (2278013)..(2278101): a, c, t, g, unknown or other
  modified_base (2282838)..(2282923): a, c, t, g, unknown or other
  modified_base (2283981)..(2284008): a, c, t, g, unknown or other
  modified_base (2284319)..(2284358): a, c, t, g, unknown or other
  modified_base (2285445)..(2285454): a, c, t, g, unknown or other
  modified_base (2287883)..(2287934): a, c, t, g, unknown or other
  modified_base (2288956)..(2288989): a, c, t, g, unknown or other
  modified_base (2289461)..(2289536): a, c, t, g, unknown or other
  modified_base (2290817)..(2290882): a, c, t, g, unknown or other
  modified_base (2291239)..(2291297): a, c, t, g, unknown or other
  modified_base (2293503)..(2293555): a, c, t, g, unknown or other
  modified_base (2295573)..(2295612): a, c, t, g, unknown or other
  modified_base (2297577)..(2297654): a, c, t, g, unknown or other
  modified_base (2298419)..(2298428): a, c, t, g, unknown or other
  modified_base (2299801)..(2299856): a, c, t, g, unknown or other
  modified_base (2303354)..(2303363): a, c, t, g, unknown or other
  modified_base (2313698)..(2313707): a, c, t, g, unknown or other
  modified_base (2314153)..(2314163): a, c, t, g, unknown or other
  modified_base (2314571)..(2314618): a, c, t, g, unknown or other
  modified_base (2315528)..(2315541): a, c, t, g, unknown or other
  modified_base (2324392)..(2324475): a, c, t, g, unknown or other
  modified_base (2326881)..(2326890): a, c, t, g, unknown or other
  modified_base (2333611)..(2333740): a, c, t, g, unknown or other
  modified_base (2335193)..(2335237): a, c, t, g, unknown or other
  modified_base (2335534)..(2335665): a, c, t, g, unknown or other
  modified_base (2336251)..(2336266): a, c, t, g, unknown or other
  modified_base (2339776)..(2339870): a, c, t, g, unknown or other
  modified_base (2344083)..(2344092): a, c, t, g, unknown or other
  modified_base (2344651)..(2344766): a, c, t, g, unknown or other
  modified_base (2345611)..(2345676): a, c, t, g, unknown or other
  modified_base (2347011)..(2347020): a, c, t, g, unknown or other
  modified_base (2350905)..(2351028): a, c, t, g, unknown or other
  modified_base (2351614)..(2351711): a, c, t, g, unknown or other
  modified_base (2352537)..(2352601): a, c, t, g, unknown or other
  modified_base (2354162)..(2354171): a, c, t, g, unknown or other
  modified_base (2354450)..(2354534): a, c, t, g, unknown or other
  modified_base (2355318)..(2355404): a, c, t, g, unknown or other
  modified_base (2356004)..(2356121): a, c, t, g, unknown or other
  modified_base (2357042)..(2357087): a, c, t, g, unknown or other
  modified_base (2358740)..(2358769): a, c, t, g, unknown or other
  modified_base (2359159)..(2359175): a, c, t, g, unknown or other
  modified_base (2360254)..(2360295): a, c, t, g, unknown or other
  modified_base (2362214)..(2362223): a, c, t, g, unknown or other
  modified_base (2364800)..(2364874): a, c, t, g, unknown or other
  modified_base (2367490)..(2367529): a, c, t, g, unknown or other
  modified_base (2368599)..(2368616): a, c, t, g, unknown or other
  modified_base (2370771)..(2370816): a, c, t, g, unknown or other
  modified_base (2372064)..(2372073): a, c, t, g, unknown or other
  modified_base (2372339)..(2372394): a, c, t, g, unknown or other
  modified_base (2373493)..(2373547): a, c, t, g, unknown or other
  modified_base (2375150)..(2375294): a, c, t, g, unknown or other
  modified_base (2378218)..(2378363): a, c, t, g, unknown or other
  modified_base (2381594)..(2381645): a, c, t, g, unknown or other
  modified_base (2383346)..(2383441): a, c, t, g, unknown or other
  modified_base (2385046)..(2385124): a, c, t, g, unknown or other
  modified_base (2386435)..(2386487): a, c, t, g, unknown or other
  modified_base (2390127)..(2390159): a, c, t, g, unknown or other
  modified_base (2391065)..(2391152): a, c, t, g, unknown or other
  modified_base (2394720)..(2394896): a, c, t, g, unknown or other
  modified_base (2395492)..(2395501): a, c, t, g, unknown or other
  modified_base (2396620)..(2396707): a, c, t, g, unknown or other
  modified_base (2397889)..(2397908): a, c, t, g, unknown or other
  modified_base (2398331)..(2398441): a, c, t, g, unknown or other
  modified_base (2399168)..(2399177): a, c, t, g, unknown or other
  modified_base (2404578)..(2404710): a, c, t, g, unknown or other
  modified_base (2405658)..(2405722): a, c, t, g, unknown or other
  modified_base (2406159)..(2406201): a, c, t, g, unknown or other
  modified_base (2412396)..(2412491): a, c, t, g, unknown or other
  modified_base (2415046)..(2415223): a, c, t, g, unknown or other
  modified_base (2420614)..(2420623): a, c, t, g, unknown or other
  modified_base (2422821)..(2422953): a, c, t, g, unknown or other
  modified_base (2424037)..(2424125): a, c, t, g, unknown or other
  modified_base (2425646)..(2425709): a, c, t, g, unknown or other
  modified_base (2426045)..(2426121): a, c, t, g, unknown or other
  modified_base (2426432)..(2426478): a, c, t, g, unknown or other
  modified_base (2427465)..(2427492): a, c, t, g, unknown or other
  modified_base (2428045)..(2428054): a, c, t, g, unknown or other
  modified_base (2431188)..(2431197): a, c, t, g, unknown or other
  modified_base (2431846)..(2431939): a, c, t, g, unknown or other
  modified_base (2432318)..(2432436): a, c, t, g, unknown or other
  modified_base (2434417)..(2434447): a, c, t, g, unknown or other
  modified_base (2435795)..(2435825): a, c, t, g, unknown or other
  modified_base (2442043)..(2442066): a, c, t, g, unknown or other
  modified_base (2442563)..(2442572): a, c, t, g, unknown or other
  modified_base (2447768)..(2447834): a, c, t, g, unknown or other
  modified_base (2448396)..(2448434): a, c, t, g, unknown or other
  modified_base (2449011)..(2449020): a, c, t, g, unknown or other
  modified_base (2449348)..(2449403): a, c, t, g, unknown or other
  modified_base (2454503)..(2454512): a, c, t, g, unknown or other
  modified_base (2462539)..(2462548): a, c, t, g, unknown or other
  modified_base (2463655)..(2463730): a, c, t, g, unknown or other
  modified_base (2464309)..(2464477): a, c, t, g, unknown or other
  modified_base (2465276)..(2465285): a, c, t, g, unknown or other
  modified_base (2465580)..(2465723): a, c, t, g, unknown or other
  modified_base (2469931)..(2470090): a, c, t, g, unknown or other
  modified_base (2474435)..(2474456): a, c, t, g, unknown or other
  modified_base (2474788)..(2474900): a, c, t, g, unknown or other
  modified_base (2475771)..(2475828): a, c, t, g, unknown or other
  modified_base (2478326)..(2478349): a, c, t, g, unknown or other
  modified_base (2483201)..(2483210): a, c, t, g, unknown or other
  modified_base (2483829)..(2483908): a, c, t, g, unknown or other
  modified_base (2484519)..(2484556): a, c, t, g, unknown or other
  modified_base (2489185)..(2489251): a, c, t, g, unknown or other
  modified_base (2490581)..(2490700): a, c, t, g, unknown or other
  modified_base (2494301)..(2494458): a, c, t, g, unknown or other
  modified_base (2495692)..(2495739): a, c, t, g, unknown or other
  modified_base (2497227)..(2497416): a, c, t, g, unknown or other
  modified_base (2497722)..(2497924): a, c, t, g, unknown or other
  modified_base (2502545)..(2502594): a, c, t, g, unknown or other
  modified_base (2503385)..(2503412): a, c, t, g, unknown or other
  modified_base (2504328)..(2504491): a, c, t, g, unknown or other
  modified_base (2505157)..(2505233): a, c, t, g, unknown or other
  modified_base (2512292)..(2512301): a, c, t, g, unknown or other
  modified_base (2513115)..(2513188): a, c, t, g, unknown or other
  modified_base (2515314)..(2515408): a, c, t, g, unknown or other
  modified_base (2516409)..(2516448): a, c, t, g, unknown or other
  modified_base (2517252)..(2517341): a, c, t, g, unknown or other
  modified_base (2520552)..(2520604): a, c, t, g, unknown or other
  modified_base (2521018)..(2521055): a, c, t, g, unknown or other
  modified_base (2521651)..(2521674): a, c, t, g, unknown or other
  modified_base (2521971)..(2521980): a, c, t, g, unknown or other
  modified_base (2522781)..(2522862): a, c, t, g, unknown or other
  modified_base (2525050)..(2525184): a, c, t, g, unknown or other
  modified_base (2525887)..(2525950): a, c, t, g, unknown or other
  modified_base (2532956)..(2532970): a, c, t, g, unknown or other
  modified_base (2534082)..(2534091): a, c, t, g, unknown or other
  modified_base (2536893)..(2536973): a, c, t, g, unknown or other
  modified_base (2538635)..(2538771): a, c, t, g, unknown or other
  modified_base (2539384)..(2539442): a, c, t, g, unknown or other
  modified_base (2541569)..(2541642): a, c, t, g, unknown or other
  modified_base (2542845)..(2542925): a, c, t, g, unknown or other
  modified_base (2546471)..(2546636): a, c, t, g, unknown or other
  modified_base (2549818)..(2550010): a, c, t, g, unknown or other
  modified_base (2553399)..(2553471): a, c, t, g, unknown or other
  modified_base (2553870)..(2554072): a, c, t, g, unknown or other
  modified_base (2558574)..(2558727): a, c, t, g, unknown or other
  modified_base (2559795)..(2559845): a, c, t, g, unknown or other
  modified_base (2563597)..(2563764): a, c, t, g, unknown or other
  modified_base (2564400)..(2564517): a, c, t, g, unknown or other
  modified_base (2564975)..(2565050): a, c, t, g, unknown or other
  modified_base (2567310)..(2567342): a, c, t, g, unknown or other
  modified_base (2569177)..(2569261): a, c, t, g, unknown or other
  modified_base (2573887)..(2573991): a, c, t, g, unknown or other
  modified_base (2575689)..(2575713): a, c, t, g, unknown or other
  modified_base (2577752)..(2577761): a, c, t, g, unknown or other
  modified_base (2579340)..(2579483): a, c, t, g, unknown or other
  modified_base (2580287)..(2580314): a, c, t, g, unknown or other
  modified_base (2585366)..(2585394): a, c, t, g, unknown or other
  modified_base (2587179)..(2587217): a, c, t, g, unknown or other
  modified_base (2589109)..(2589137): a, c, t, g, unknown or other
  modified_base (2589514)..(2589583): a, c, t, g, unknown or other
  modified_base (2593958)..(2593967): a, c, t, g, unknown or other
  modified_base (2594336)..(2594462): a, c, t, g, unknown or other
  modified_base (2594996)..(2595142): a, c, t, g, unknown or other
  modified_base (2595489)..(2595498): a, c, t, g, unknown or other
  modified_base (2597021)..(2597145): a, c, t, g, unknown or other
  modified_base (2597414)..(2597525): a, c, t, g, unknown or other
  modified_base (2603531)..(2603743): a, c, t, g, unknown or other
  modified_base (2608231)..(2608317): a, c, t, g, unknown or other
  modified_base (2609359)..(2609406): a, c, t, g, unknown or other
  modified_base (2610262)..(2610474): a, c, t, g, unknown or other
  modified_base (2611783)..(2611869): a, c, t, g, unknown or other
  modified_base (2612227)..(2612366): a, c, t, g, unknown or other
  modified_base (2615590)..(2615599): a, c, t, g, unknown or other
  modified_base (2617770)..(2617897): a, c, t, g, unknown or other
  modified_base (2620490)..(2620506): a, c, t, g, unknown or other
  modified_base (2620934)..(2620981): a, c, t, g, unknown or other
  modified_base (2621979)..(2621988): a, c, t, g, unknown or other
  modified_base (2624797)..(2624824): a, c, t, g, unknown or other
  modified_base (2628315)..(2628324): a, c, t, g, unknown or other
  modified_base (2629051)..(2629186): a, c, t, g, unknown or other
  modified_base (2629534)..(2629583): a, c, t, g, unknown or other
  modified_base (2630580)..(2630623): a, c, t, g, unknown or other
  modified_base (2633163)..(2633195): a, c, t, g, unknown or other
  modified_base (2633566)..(2633575): a, c, t, g, unknown or other
  modified_base (2636241)..(2636374): a, c, t, g, unknown or other
  modified_base (2638931)..(2638996): a, c, t, g, unknown or other
  modified_base (2648691)..(2648749): a, c, t, g, unknown or other
  modified_base (2649039)..(2649156): a, c, t, g, unknown or other
  modified_base (2652779)..(2652816): a, c, t, g, unknown or other
  modified_base (2653564)..(2653743): a, c, t, g, unknown or other
  modified_base (2654051)..(2654188): a, c, t, g, unknown or other
  modified_base (2654675)..(2654721): a, c, t, g, unknown or other
  modified_base (2658488)..(2658501): a, c, t, g, unknown or other
  modified_base (2660978)..(2660992): a, c, t, g, unknown or other
  modified_base (2662465)..(2662474): a, c, t, g, unknown or other
  modified_base (2664488)..(2664508): a, c, t, g, unknown or other
  modified_base (2664866)..(2664875): a, c, t, g, unknown or other
  modified_base (2667896)..(2668084): a, c, t, g, unknown or other
  modified_base (2668359)..(2668368): a, c, t, g, unknown or other
  modified_base (2670681)..(2670848): a, c, t, g, unknown or other
  modified_base (2679230)..(2679301): a, c, t, g, unknown or other
  modified_base (2682586)..(2682595): a, c, t, g, unknown or other
  modified_base (2689898)..(2689907): a, c, t, g, unknown or other
  modified_base (2690243)..(2690274): a, c, t, g, unknown or other
  modified_base (2690904)..(2690928): a, c, t, g, unknown or other
cgccacggtcttcgtttcggtggcttctggtcacctgaccctccttgcggtaggtcaggtgttgcaacgatcactagaacccgccataatcgtcaaacgctagggggggggggacaccgcatggtgcgaggtttgccgcatggcggaggtgccatcgggtggagtatttggcaccccttggcaggtatttggcacattggcccccgcaaaaagcaaatggcccttggaattattccaagggccatttgcggctaatagcaccggagcattactcctcgaaaattaatctacgcgtgcggagaccgccgttcgaagccgaagacgcactgaagtacgtcgagtgctgaggaaagacggtatacgctccgtagattagttttcctcggcgtccgggtcgtagtcgacgccagtctcggcgcgctgctcgtcggaaatcggggccggagcaccggtcagcgggtcgcggccgccgccggccttcgggaaggcgatgacgtcgcggatggagtcggcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggaatcggacatggcgtgctcgggatccttgtcgaacttgtcgatccaatccttggagggcatggtgaacgggtggtgcatggaggtccacttggagtggccgacagccacatcgtcatcatccggatcgtcggtgggcttgaacagcgggaagtccacgacccaggtgaaagcgaacttcttcggatccagcaggccttcgcgggaggcgagttccacacgcacggcacccagcagcagctgggcggactcgcgggaaccggcggcgaagaacacggcgtcgccttcctcggcaccgacggcctcgcgcaggccggcgcgctcctcatcggacaggttcttggcgacggggcccttgagctcgccgttctcgccgaagaccacgtaggcaaggcccttggctccacgctgacgtgcccaatcctgccaagcgtcgaactgacgacgcggcgtggcggcaccgcccttgaagaccacggcacccacgtacggggcctggaacacgcggaacggcgtgttcttgaagtattcggtcagttccaccagcgggttgccgaagcgcaggtccggcttgtcggagccgtacttgtccatcgcatccttccaggtgatgcgcggcagcggcagctggacttcatagccggcggacttccagatggcggcgatgaccttctcggtcatggccatcacatcttcctgatccacataggccatttccatatcgagctgggtgaactcgggctgacggtcggcgcggaagtcctcgtcacggtagcagcgggcaagctggtagtagcgctcgacgccggagaccatgagcagctgcttgagcaactgcggggactgcggcagggcgtaccaggaaccgggcaccagacgggccggcaccacgaagtcgcgggcgccttccggggtggacttgatgaaggtcggggtctcgacctcggtgaagtccatgtcttccagcgcgtggcgggcggccttagccatgtcggaacgcagcttcagattgtgctgcatggacgggcggcgcaggtcgaggtaacggtacttcagacgcacgtcctcgccaggcagcttgttctcggactcattctcgagagcggtggaaacctggaacggcagggcgtcggacttggcgaggatttcgatagtctcggccacaacctcgatcttgccggtggccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcgagggtgaccttctggccgaccagggcctcggtcacttcagtggcatgatgtgttctgtaagccgtctggctcattgtcttgtttctcctcgatttttcgcgcgaatacgtcagatttcgacggtttgctgggcaaccacagtatccggctcccacgacgtgcaatcggcggcaacctgctcgcccgtgacgatgttcttgacctcgtcgccagcgggctctgcgccttccacaccttcggcagcggtggccgggaaccacacgtacggaatgccgagtttgtccgcgtacttgatctgcttgccgagcttggccgcggtgggtgccacgtcagtagcgatgccgcgcgcacgcagttggttcgcaatacgattggcggccgggcggtcctcttcattccacacagcgaccagcacggcggccgggctgacacggttggcgtgagcgccggcggtgtgcagcatgtagctgaccagtcggctcaggccgatggacaggcccacgcccgggtacttgcggttgccctgggaggcgagattgtcgtaacggccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcttcgtcgacgatcatggccagggtatcgagtccctgacgagccagcgtgtaggcctcggaatccttgacgatgccgtgagcctcgcacagcgcatcgaacttagcggcaagctcggcaccgtcggaggcggtgagctcggccaattcgaggcaggcgcgcgcctgtgcctcggtggcgccgcaggtctcggtgagcagtcgggccacctcatcggcaccgatcttgtcgagcttgtcgatctcgcgcagcacgccttcgacgtccgtcaggccaaggccacggtagaacccctcagacaacttgcgattattggcgtgcacggtggccttggggaggccatacgcgcgcagctcttccagtgcggagaccatgaccagcggcagttccacttcatagtggtcgggcaggtcgccggcgccgatcacgtcgatgtcggcctgcacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaacgctcttcaatcggagtgtcggattcatgaccgacctcctgcaaacggctcagcaggtaaatctccttgctggtctcgccttttttcagcaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaggccagcgcggccacgccggcgccgactccgtcccccgcttccatgccgaaaccgcacgcgccctcccccgccgccttcgccaagaagactccggcggccaagccgcgcgctgccgccccggccgccgccaccgccgcctattccgaggctgatgtcaaggccgccgaggccttcggccgcgtggatgacaacggcaccgtcttcgtcaaggatggcgacgccgagcgcgaggtaggccagttcccggatgtctccaaggaagaggcgttggcactgtacgcccgtcgtttcctggatctcaaggccaagctcgatctgctggccacccgcctggcttccccgaacatcaaggcccgtgaaatcgacgaatccgtgaagctcttgggtgaagaaacctccgagccagccgtcgtgggcgatcttgccgcactcaagacccagtacgaggagctgaaggctgccggcgaggccaagaagaccgaaatcgccgaggcacgcaaggccgcccaggccaaggccgttgccgagcgcaccgccattgtcgagaaggctgaagcactggccgcttctctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgtcgcccgtaccaccttcaaccaggctcgccgcaagtgggctcaggctcgcgacaacgagcgtacagccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggccgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgatccggaggccgacgcccgcaagtccagcttcgaagagcagcttcatgctcagctcgccgtgcttgacgagaagatcgccgctgagtccgacccgaagaagaaggccaagctcgaggccgagaaggccaccaaggagcagtggctgaacgccatcaagtaagacttccgcttatgcccccgctggcgggggctgtccaacatagtcggactgggagtggttccatacaacggccacccccagtcggcaaaccggcagccccccccccgccagcgggggcaaatttgtagctgccggccccgccaacgagcggggctcattcatatctacgcccgtgtgccggtttcaggcacggcagcagatagcttcgggtgcgcagccagatattcgtgcagcggctggttataggacatttccagttcaccatagttgctgcctgcacggaatgccgaatagttgtcgccgccctgcagcaggtaggagttggaggcgatgatcaccagatcgtcgtcagcgatcggcctgccgtcgatggtgaggtccacgatgccgacggtggccttaacccctgtatgctggttgccgtttccgtcggaatccccgagtgtgcatgtggcgccaccatctccgcactggacgtaccggtatcgcacattcgaggagatgccgagccatcggtgttccaattcaccgtcatcgttgcgatgaaactgctgggcgagcaccgccttgagtccgagtccggtgagggtttcgtgcgcggcgtggaactggagggccatcagactgtcgacctcacgaatcgtgaccttgccgtcctcgtccatatccagctgtttggttctcaggctgccatcgtttgagaacccgaccacgggcaatcgggtgccggcatacacattccgcatgatcgactcccggttggcgtccgccacaagcatgcccaccgatccttcatgtccgacggacgtgcgcttgtcgaaattcgttcccggcgccagagtgccgatcaccgcgttccccgccctggccgcgtagttggccttcgtgtcgagctgccgcgagcgcgctacgctgccgttcgacaccacgccggcggacatccaggcggcctgacgcggatgggcgtccagcccctccacgttgagcacgcccggaaccgcagtggcctcggtgccgttgccgaggttcacatcggccacctggaccttggcatgacgaccatggccggtgatgatcagatcctgcacggccatgttctggccgaagctaccggcctcatagatcggtgcccctccgtcggtgacgccttgttttacggcgtgggtgtggccggtgtaggcgaggtccacatcacgtccgagaccggttgccgccgaggcgtcggcgtgcaacaatgcgaccaccgcatcgactttgcccgaacgcttcagttcaccggccacgcggttgagcgcgtcgacggcacgttcgctcagatcggcgtcttcggtgatctgcggcgtggccaccgagccaagcgcgtccgtgagcgcgcccacgaaaccgatgcgcttgccattcaccgtgcgaatcgtatagtccttgacatggctcagtttgccggtagctgatttattggccgaggacacgttggcgcagagccagtcgatgccgttggccggagcggccacacgattgttgaagtcggccacgctgcgatcgaattcatggttgcccacggcagaaaccgtcagcccccacaccttggccatgtcaagggtgggtttgtcttgcctcacggccgactcatagggcgatccgcccaccagatcgccggtggagacgggaaccatattgtcggggttgtgactgtccgccaaggtgaaggcggctgcgacatcggccccatgttcgatatgaccatggaaatcggtgatgtcggcgatggtcaccgtgcgtgtgccggtggccggatcctcgccggaaaaaggaacggctcctgcggcacccgcgatattgggtgccacaagagccgtcatcatgatgagcgcgacgatgacgcccatcgttctgcgatgtctgcccgccgtgaaccggcggcggttcgtgtccctgttcacgctttcacggtaaacgcgcaggttgaaccgcatgggcttcgcatttggccggcagatgaattcccggttatttccgcccacagcgtctggccgaatcgggccgtcttcgttggttcggcggtgccattcgccaagctcggcggcgcagatggcggccacagcggcgtgttccgactcgcgggagccgaagcacgccgactcgtttgaccgcccgacgggccttagacgggccttattcgctggcgttcagagacatacgaggagccatatgctcggcgaagaagctcagcatcgattcgacggcctcccgggtctccttgagccaaggcatgcccacgatgtagttatggggcaggcattcgcgcggagcggcacgatagtccagcaactcatggtcgatgcccagcttgcgcagctcgacacccagttcgaggctggtggcttcgaggaagtcatcagtgctcgtggccatccagaccggcggcagaccagcattcacgaccagctgagcgagcctttcgaacttcgtccccttcacacgctcaacatagcgcgtgaaacacggagccagctcctcgacaagcccaccggcatcataggcgttctcatcgaacagccggtccagatcggccatcgcggatttgagacccaaggccctcagaccaagcttcgcgggatgcacgtcgagcagggaagcatattcgtcgttgttcatggcggccgtcagatgcagcaccaaggtcacacccgccgaatccccggtaaagaaaacctggttcgtatccagcagatacctgccggaggatttcgacacccactccaaggccgaggccaagtccctcagctgcgtgaggaagtccaccgcgggatacaggggatagctcacggacaccacggcatacccatgacgggcaagctcgatggcatgcgagcggttaatctccttgaagccatagaagtacgcccctccatgaacctcgaagatcaccggaacagccgctccgccacggaccacggcatcacggggcaacagcacgtccaacaggtgtccacgcgtcgcgtccggcagatatgggatgtcgccatacagcaccacatcatccggaatctcacgcttgaatgcataccgaggcaggtcgttatgggcaaaattcgtacgatgctggagcacgtcagcagcgatggccggatcgacgccctccaaatcctcgtcgaaatacgtccaggtttgcgcgaccttcttctgttcttcggtcagaccgtcgttgcgctcgaaaaggaatgcgtcggcgccttgcagatcggtgatcatcaaatctccgccttcatatcctcaagctcaacgccgttggtctcgggcagcttcttggcgatgaaccagtatccgaggacggccatcacggcgtacagggcgaaggtccaagtcaggccgaggctatcacgcagcggcgggaaggtggtggagacgaggaagttgccgatccagttggcggcggtggccagcgccaccgcaacggcgcggatgcggttcgggaagatctcgccgatgacgacccacatcgccacgccccacgtcgcgcaataggtcaggaagaacccataggcgccgataatcatgatgatggcccacgcaccgggcagctcgatgccgccatcggcggtcatcgtggattgggcgaagcaaacggccaccacgaccagaagcacagccatgatcagggacccgaccttgagcatggcgcggcgaccgaccttatcgatgatcagcatgccgagcacggtgacggcggtggccagcaaagcacgcaccacagcgatggtcatagacgcggactcggtgaaaccgacagccttccacaggctggaatcgtataacatgatgacgttcgcgccggacacctgctggaacagggcgacgccgatgccgatccataccacggatttgaggccgaaggtcttgccgcgcagatcggagaccttgggctgcgtctcgccttcgaggctctgggcgatctgctcgaccgtcgcggaggcgttgcggtcgcccacgacttcgagaagcaccttctcggcgatggccttcttgcccttcatcaccagataacgcggggattcgggcagcgcgaaggtgagcgcgaacatgatgacgcccgggacggctgtggtcatcagcatccagcgccaagtctcgagtccggcccagaacgtcacggcggcgccgcccgagccaagaagataggagtcattgaccacaagggaggccacgatgcccaaggcgatggccatctgttggaagccggtgaggaatcctcggcgtgacgacggcgatatctcggagatataggcggggccgatggctgaggtgaatccgacgccaagtccgcccacgatgcggaaaatcacgaacacccagatattggacgccagaccggtgaacagggcgctgaatacgaacagcgcggcggcaagctgcatgacgcgcacacgaccgatgcgatcggccagcgtgcccgcgaaccatgcgccgaccacgcagccgatcatggcgctggacaccgagaaaccgctcatggcggcgttcaacccgaagccggagtcggggctggcgatggcgtccacggcgccgttgatgaccgaggtatcatagccgaacaggaaaccgcccacggcgccgatggtggcgacggtgatgagcttggcatgcagtttcgttggcacttcattgttttgattcatggattgcctcctttgcctttcatgaacctggttcgatgatagaagcaattcggcgggatggcatcggtggactgtgacctatcagggacaaagtgtgacctatggtgtgacgccttcgtcacagagccaccagttggaagacgctcacaacgattccgttcaccggcccttcttcgaactggtccgtcaatcgtcatcgcagttgtgcgagagctcgatgtcacgccactgcccgggcgtgagaccaaatttacgctcgaaagccgcttggaaccccctttcattgggaaaaccagccacccgtcccacttggccgatgtccgcatcgggcatgcgtagccgttcgcaggccactttgagtcgtaactcattgacgtaatccataaacgaagtgcctgaatattttttgaaaagccgggagaaatactcacgcgaatatccgaagtgccttgccgcttcgctggtagtgatggacgaaagaaaatgatcccgggcatagcgataaatcaacgatatggactgactgtccccgtcgtcaggtccatcaatcgccttcgactgcatgaagtcgtcgaatatcctgcccatcaacgcgaagaacgcggcattggcgttcacatacttcacctgggatacgccaacaagctggtcgtatatctcatcgcataacggggcaaaggccactcccccatgcctgttgcagcggtcatagtccacttgacgctgcgcctgcagaatccgtggaaggaatgcggacatctcaaccggattgaccgtgacggacaacgcctgcggcgtggtcccccggtcctcatccttcaccatgtgaaccgcatgcacggcctccggcggaattacatgcgcctgtcccggctgcagcacggtcatggcgccattcactacgacggacatggggcagtccttcgcgtacagcacctcaagaccgctatgccagtgatatctcgctttgtcatagctttgatgggctatgaccagcgccggaaactgcgtcgttgataccagcaactcctgcttggagtcatcgacatagcgcataccgcatcctttctccgaatggatatcatctccgaatggatatcacccaaccatgttccatcatcgatgtgctcatcgtatcgacgatccttgccgcaaaacatgaaagccagtcatccggccggctttcatgttggagggaggctacgctactcggcatcgttggaaacgggaccatcgttcgacggctcggactccgtttccgcgggagatcccgcctctccatcgaccgcagaaacagaatcccccgtctcggcctcaggctgttcgaaggtctcgcccttgaaggtgaactcacccagcagaccttcgccctcggcgtcgacgataaccttctgaccgtcttcgagatcgcccatcaggatcttctcggagatggcgtcctcgatgtcgcgctgaatcacgcggcgcagcggacgggcaccgagcagcgggtcgaagcccttctgcgcaagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgaaccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcaggttacggtcctggatgtaccggctggacagctctgcggcagactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtgaatctcgtcgatgaacagcacgatgtcgccacgagtcttgatttccttcagcaccttcttcagacgctcctcgaaatcaccacggtagcgggagcctgccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggaaagcacgaccataacgcgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggtcgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcgtccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggaatcgtcgctggaatcagctgcatcaacatccacaacggaatcagatacgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggctcctgcttgcgcggacggttggccaccacgtcgatatgcagatcgtcgaaagcaggcttggactgcacccacagctggcttggctcgggaggttcgatttcggaatgctcgccgcagccgtggtccaaggaaaccacgcggccgtcatccggactccacttgttggcgcacacgccgaacatacggtcgagctcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccttccaaggaatccacttgggcggcatcaacgcgtcctcagtggggatcaaggaggattcgttgacggtccaagagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgccggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgttggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtaatgatctgcttggccaccgcctgcgtagtgaatgcctgaccgagcgtgatgccattggtatcgccataggtaggcagaatcggcaccgatacgataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcggaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcagttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcgagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttgctcactcggagcgggcttcacccgaagacagcttgacaacatcctttgcctgcgtgcctttgccggacgaagcgggcgtatactccacgcgatcgccttcgtacagcattttgaacttattggtgctgccgtcgtccttgatttccgcgtagtgcacgaaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgatgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccgaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcattatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcgtcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcattgtggcggtggataccaccgggtcgatggcggtggccgacgccacatacgggtccgagaagaccattacccgcatcgatgccgcacgccaggccgtgcatgatgtgaccgccgcttatccggacgccagtttcgcggcgttacggttcggtgcttcggggacgcttgatgtgccgctgaccccggatgcgccggccatcgataattgggccaacacgttggcggtggaagccacatccgtgtcggcgggctccagtctggatgctccgatcgatcaattgctgctgaccgtgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcgtcgaagcagtggcgcatgaccaccacggtcagggaacgcacacgcaccacgccggtggtatggccgttggccattgcgttggcgatattgcttgccatggaagtcggtgcatggatcgcaacctcaaggagactgctgtgagaaacagtaacgaaatccacgagaacgatggctcggcgaatactcggatgcgggcgaagtgtccgctttgggcacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgacgcgcaattcgacgaggccgggcgaatgcgcacgcttctgttgccgcaagtcaaggacgccatcgacaccaatgcttcgatttcttccgagctgacaaagatcaccctgaaacaggccgaggcgcagaacagcggttccgattccgggcaagcccagtcggcacagcaatccgagaattcttcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggctaccaagccgtggtaagcagtcgttcacagttgttcttttttctcacaccctcacgggtcatggctttatcgcggctgtttcccggtttcggctgtcggctttggcatttatccaattttcgataggccatggctgatccaaggtatgtccaaacaggctatttgtggataatcgttacgactatgcacaacacttggggataacttcacccaaaatcggcaagctagaaccacattggtcgttccggctggacaagcatgagtcttgtccttttagctggatatatgaatacctacaccagcaacccagcacccatcgatcccaccggcggctttgccggcaatacggtgacgccgttcgattacggcacttgcccttgccatgcggcggtacagcgtagtcgcgacctcgtgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcgtcatgagcgagcacgattactggcaagtggaatcgtccgtttacggcggagtgggatatgcgccagccactcttgaagaatatgccgccatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggcgggtgttgccgctgtggcggcgggcggctttctggccggctggactattgacggcaaaccgaacccggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgttgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggtctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgatggacttatgattccccatcccacgtcataacgaaatcgacaacaacctcgcggacattatttgcaaagaagcagaagccaaactcgggaaaggctggtatcagcagtgaaaacatatcaggtcatcgttcgtcctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcagcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgctagcatgcccgaaaccccctctatcagcgcaacattcccgggaaagtggcgcgcaaagagtgtcaggcgcgtcgctcgatgagtgcgcggccggatgcgaggcggtcgagcacaccggttttggcgatggccagcatcagataccaggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatgatgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacctgggcaagatcaacggcgcgaccggcacgttcggtgcccacttggccgcatgcccggatgtcgactggatcgctgtctcccgcgagttcgtcacgaaccgcatgggcctgacctggaacccgctgaccacgcagatcgaaagccacgactggcaggccgagctgtactccaccgtctcccacgccaaccgcatcatgcacaacctgtgcgtggacgtgtggatgtacatctcccgcggcgtgttcgcccaggtgccggtcaagggtgccactggttcctccaccatgccgcacaaggtcaacccgattcgtttcgagaacgccgaagccaacttcgagatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggtggccttgagtccatccacccgaacacccacgtcatcgagcgtgagctggatgagaactgggaggtgcttggcgagccgatccagaccgccatgcgcgcctgcgagctcaagggcctgccgggcatggataagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcggccgctgagataggcgcgatgcgagtctctcgagtccctcgagtccctcgaatccttcgcatccaccacactactgcgctgagtcacaaaccgaaccgcaaactgaaccgaacaaggacaggcgtcaggtgaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccatacatcgacgacatcgctccgcgccgcacgcgcgacttcggcgacctgacccgagccggtctgtcgctattgatggccgccgtggtcatggtgttcgccgtgtatctgggcggcatgacgcgcggcgtcgaatccgacgcgcataccgccgcccaagccatcaactggctggctgctttcccctccaccgtactgacgcagctggccaccacggtcatcgtagttatcgtgctcgctcagttgctcttggcccgcgaatggctgcaagctgcggtgtccgcgctggccatgtttgccggatacggcattgtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatggccgccggtcgcacggtgggcatgctgatccgattcgtggtcggcacgcagaacaagggcgtgtggggccaagatctggtcgccgccctgaaaggcatcggactggacaccgcctcgctgattcggcatcaggagcccggcgtcggccacggttcactggccgtcacgctggacgacgatctggccgaaggctcgcgcatctacgatctggataccacggacaaccgtcgtttcatcgtttccgtcatcgacgcgcagacccataccgtcggctatctgaagcagttgtgggactgggtgcgtttcaccagtgtgtccatccgacgtgaccgttccgtgcgtgacgccgtccagcatcatttcgccatgctgctgggtctgcacaatatcaaactgcccgcgcccgcaccctacggcatcgccgataccgacgaatccgcgattctggtgctggatgcacacaccatcgaactgcccgccaacctgaacacgcttaccaaggcggatgccgtggcctacatgcgctacctgtccgtggcgagccggcgcggctatacgcaccggcgcatcacgccggacacgctcgcccggcttgaagacggcaccgccgtgattgccggctggctcaacggcgacaacgcttccggtccggccaacaccgcgctcgacaaagttcagctgctagtgctgttcgccgcgctgatcggcgtggaaccggcggtggaggccgcccgcgaggcgtggggagacacgactctgacggccttggccccgttcattcagaaggtcgcggtcccctcccccacgcgcgcgctggaatcctgggacaagcagctgctcaagggcctgaggagtcgtatcaccgcgctggctgacgaggagacggtggaatccgccgaaccggtgacgctggcccgattctcctggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgccagccggcgtgggcccctcgttcgtcaacctgcagttcctgcgcaaatccggctatcgcaacacccaggcgaccgcaattatgagcgccgcgctcgtggtgtattacgccgtgtacttctccatgctggtcatcatcggcctgttcaccggccgcaacatgttctccggcgcaatcccgacaaacacgttggttatcgtgctgggcgttgtggtcgtggtgctgtccattgcgatgatgattccgccgttgcgccactgggtgacccgtcgtcttatgccgctggccaagacgtatatcaaccagctgctggacgtgctttcccagccccgacagctcacagtcagctgcctgggcgcgctgttccagaacgcgaccactgggctcgctttctgggcggccctgcaagcgttcggccattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgcattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgatctcgtctcgaagatcgcccagaagtccaacctgaccaaggctcaggccgaggctgctgttaacgccttccaggatgtgttcgtcgaggctatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgggcgaaggtgacgtccgggcgacggcgtttgagcgcgtcgaacagacgcttcttggcggcccagtccacgcggtcggcgagcgcatcgtatgcaccacgctccagcgcgtccagaacgcggctccactcccccataatcgtgtcgatcgtggtggccggcagcgaacctgccagcgcatcgccatgggtttcgatgaaggccttgaccgccgcataataccggcgctgcagacccagtgcggacacggattcgcctgattcgagcgtcagttcggcgcgcggattgtcaaggaatcgactgaccgtgcgattggcggcagccggatcagcaaaggcatactgctcgaatccggacggaacgccatggcggaaggcgtcttcgatcgcgcacagcacaaggtgcgtgacggcaagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcttcgcgcgggtcgcgcgcttcggcggtggcgtattcggggtgggatccgacgtccagatacagacgtgagccattggccagatacgtgttggtggagcgggaacgggagacgatgggctggaacatggtcatcgccacctggccggcgtccacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggtctgcgtggtggcgagggcgtcgtcttcctgggtcgcggcctgctgtgcttgaggttgttcgaattgttgtggcatgttgtcttctttttgggctgtcaaactcccctcagtcagccttcggccgacggctcccctcacccgaggggagccggaggagtcaaaaaattatcgctggttgatggagtcgagccacggatactgctgcaggtaatgctgcagttcgcggatgatgagtccattggaggccactacatcgttatcgtgacgccagtggatgcgttcgccgtcccaacggctcagcgtgccctgtgcctcccagaccactacggtgccggcggcgatgcccgcgatatcccacacgtgcagcatcggctcgaagtaggcgtcataggtgccgtcggccactttgcacaggtcgagcgagacggggcccacgcgcttgatgtcggccgggcgtccggcgagcgaggaggccacgtcgagcgcacgctgcgattcgctggggatgaaggacatgccgtagctcagcacagaaccatccagcgaggaggtcatcgacggcacgaccttgtcgcgcttctcgccgaccgcggttttgtggatgcgcacggcacccgctcccctggcggccaggtaggtcaggccgagggccggggcgtgcacgatgccgatgatcggcttgggctcgttgtccgggccgaattcgaacagggcggcggtcaccgtccattcgctcatgcgacgtacgtagttgatcacaccgtcgatcttgccgatgtaccagtaacgctggccagggcggctttcggcggggcgggtggtccagaagccgtcgaagtgggcgatgtcggcgattctggcgctcatgaagcgcatgatcttgttgtccacttcaagcttgtagcgggggccacggtccgcgttctcggtgctcggctgggcgaggttacgcggattgagttggtcgtggagggcatgctggccggcttcttcgagcaggccggcgactttgagcgcaaggttgcgcaggtcctgtggggtctcttcgcgtgtttcttccatagctaccaagtctatcgttcggcgttgatggccagcgacttcagcagatcgatggcgtgttcggctgaattgagttcggtttcgcagtgcgccttggtgaaggcgagcggatcggagatgtcgagggagaacaggtgatggtcggtagcggccatatggccggcattgccgtagaattcgaccgcctcgccctcgtctgcggcgcgcgggtcgcgaacagtgagtcgggaccagctggcggcggccacctcatcgccgaattgcgccacgagttttgccctgagccaggcgcgggtgtcttccggcggttcggtggtggcgcgtgcgatgtcggcggcgctcaccacccgttcggtgcggggttcgagtttggtgaagatgctgtccgcggggtcgagcgccgcccatttcaggtcgatgaccttcagtcgcggatcattccatccgttggccacgccgggtgcggacgttgtggtgattttgcggcgcagtttttcgagcagctgccatttgagcagccattcgatgcggctggcctcgccggtcatggccagacgttcgtcatcgtcggcggcatggcggatggaggcgcagtcgatgagcgcctgctgccacatcgccataatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgaccgggtcggccagttcgagttcgtcgaggaaggcgttcagatcgaatccggcttcgtccgcgtgttcgagcagccacagcagcatgcttgtggtgccgagtttcagggcctgcggtacctccatacggttggcgtcgccgacgatgacgtgcaggcggcggtattcgtcggtggagtgggattcgtcgcgcgtgttgataatcgggcgttcgaaggtggtttgcaggccgactttggcgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcatgcgtgccccagcaggagcccttgccgtccacattgttgcgatgcagggcgatgggggtgccggtttgtgtgcgggcgcgttcggtggcggcctgcatgatgaggtctccggcacggtcatagcggaccgcttcgaacgggtcggtggtttccggtgccgagtattcgggatgggcgtggtccacgtagacgcggccaccgttgggagcgatcacgttggtgatgttgagttgtggggcgtcggtgagcatgtccgggcgggcggcggcgcgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcagccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtagatgtcatgcaccagcacggcggacaaggcgtgcgcgtcgacgccatcttccagaggcaggtcgtcggtgaggtaatggtccacgatggcgatggcctgattggctttgggccgaccaacgcgaatcttgacgtcgagacgccccggtcgtagcacggccggatcgatcatgtccacacggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaacacaaccaccggattgccgtccgcggcgcgttcacgggcacgctggaagatcaggcgaatcagccgttcggattcgccgacgtatttgttgagcagttccgggcccttgacggacaggaacacgcccttgacatgggtttcggccgggctgatcgagccgtcgccattcgtatcgtaaccaccctcgcacagggcgttcgccacggccttggcgatcatcgtcttgccgttgccgggcgggccgtacagcagcacgcccttcggcggcttcagatcgtagcgctcaaacagcgcacgatgctggaacggcagttggacggcgtccctgatacgaccaatctcactatccaagccgccgatgtcggcgaacgtgacgtccggggtctcctccagcaccagatccttgtcgccctcggcgggcagcgcttcgatggcgaggcggacggacggatcgacgataatgcggtcgccctgattgatgcccgcatacgcgagcgcgccggaacggcggatgagcacgggattgccggaggcgtcggtaacgatcagtcgaccgtcgtcaagtacctgcttgacactgcgaatctggcccacggtgtcagcatcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggcggatttcctgttacgtatcacagtacgcacttttcgcaccacgaaccatacgatgaccacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcacccagtacggagccgatggtggcccagatgattgcgcccggcagactcagggtgccgcgtgcggcggtgaagccggagagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggtgtggggtcggttgcaagaatagtggcggctgccatggaaaaactcatagagggcattgtcccaaggttttcccagaatcagaagcatgacgcaagaagatgttcattttgttgacaagtccgccgagagcgaagttgggagcccggctgattctgcggtttctgtgccgacgctgagcaagcccggcctgctggttatggatgtggactccacgctcattgacgaagaggttatcgacgagttgggcgtggtggctggctgcggtgaggagattgccggagtgaccgcacgcgccatgcgcggcgaaatggagttctgcgatgcgctgcgcgcacgagtggccctgttgaagggcctgccgatctccgtgttcgacacggtgcatgacaagctgcatttcaccaagggtgcgctggagcttatcgacacgctgcatgaacacggttggaagatcggcgtggtgtccggaggcttccatgaagtggttgacatgttggcggccgagggccatatcgactattggattgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtctgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcgtcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcggtcagagggtcagcggtgtgatttgggcacgcaccgataccagtgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcgtccggtcggcggctcattgccggataatacgcaaggcggttttgccgggcgtggcaccaatcccgatgggaccaaacttgctggctctacctttgccgttgctagcaccgtttcggagggagctgcgcaggggtatcgtcgtctgaccgccaattacgccgatgtcaatgtgcttcatgacgcgcttaccggtcaacgtttccaatcttttgtgtttgattcgttgcccggtgcacaggagtggcaacgaaacatggcatggatggtggccactgcgttgagtgccggtaaggctgccgtagttgaattgcccaccatgcgcgaggtcgaagacctgatgcatatgctacgcaattatggactcaaaccatttgccccggctccaaccggcggatggatgggcgatgtcgccgtgctcaatgcggagaccatgcctgcggccgaccggtaccgcacgtatctggctgtggcgttgggccaggtgaaggtggtgatcggcacccgcgcggtgatgtatgcgccggttgaaggcccggcactgttcgccattctggaggatgccgcctatcagaacatggacggtatgatgccgtatccacaggctcgcggcgtgatgcggttgcgcgccaagtcccatggcggcgtgttcgtggccatggccaatgcgcgcactccgcaaagtcagtgggaaaacaccggtccaggtacggtggaaactccggtgagcggctattccaccgcgattcatccgctcgcctcgccactgaaggatgcgacgccttgggtgcgttggctcaatcgcgatgagcttgcgcgtctcgctgacccgtccatcggggcgcgcgtgccgcatacggccgtccgcgtgctatctaaggctttggaaagtggccccgtgctgctatccattccgcaagacaatgtcagtgagaccttgagctgtgcgaaatgccatcgtcaggtgcgttgtgccaagtgttccggaccgttgcaactgccggccgaccgtcgggattctacaccgcgatgccgctggtgtggggctgccgccatcaactggaagtgcccgggctgtgggcatgaacgtatgcgcgtggtgcgtgtgggggctgccggcactgcggcggagctggccggattgttccgtggcgtgccagtagttttgtccagcaagacgcagggtctggtgcgcgatgtagcttgccagccgatgattgtcatcgccactcccggtttcgaaccgcgcgtgcgtccggtcagtgccgaacagggatcggctggccatgagtatcgtgccgtggccgtgctcgacgcttggaccagcttgtatgcgttgggcgtggatgctcggttggatacgttgaccgcgtggatgcgtgcgatgtcgttgtgcgcgccgcgttcccgtggcggccaggcgttgattctcggcgaaaccgacccggccatcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgcgctgggcggcgattggacggcctgcggcgagctgcccggcatgttgggcccggtgccgatcgcgcaaccggacacagttgatgccagggagctcgaagccacggccgaccgggtgaaggcagtaatccgtgtgccacagagtcggcgagccgaactggcggcccgactgcaccgggaaaccgctcgtcatgtagcgtcccgcgagcccggcgagcttcgcttccgagtagatcccaaagatctgatctaatcgtctccaacacgtgaaacgatgattacagaacgaacatcgctataaggaggacaccatgaagggttggcccggagagccggatatggattacgacgtgctggtcgcggacggcgaagccgccgcgaacgccggcaagccgatcaccgacgtgatcttcgatttcggcaacgtgctgatttactgggatccagtggccgtgctcatcccccgctacagccagaagaccatcgacgaattcctcgacaacgacatctccggcttctacgatgtcaacgacctgatggacggcggcaccagcaccgacgaggccatcgccatcatgcgccgtgacaggggcgataagtgggcggacatcctcgactactacatcaagaacttccgcgactccctgaccggcatcgtgccgggcgcacgcgtgctggtcaatgacctgaaggccgccggtattggcgtgtggggcctgagcaactgggaatccagccttttccacgtggccgaggaacagtgcgatattctgcagcagcttgatggcaagctcgtctccggtttcgtcaagctgcgcaagccgcacaaggaaatctacgaggccgcgctcaatcagttcggtatcaaggccgatggcgcgttgttcatcgacgacaaggccatgaacatcgtcggttcgaatgcggccggcatccgtggcgtgcgtttccaggatccggtcaagctgcgtgaactgctcatcgccaatggcgtgaacattccggccgtgcagtgagcatcgacgttttaaggaggaccatgctcaaactcgtgttcgccggcacccccgatgtagcggtgccctcgctcaaggcctttgccgccgatccacgttttgatgtggtcggcgtcatcacccgccccgacgcgcctaccggccgcggccgcaagctcacgcccagcccggtcaaggcgacggctctggagctcgggttgcccgtcatcgatctcaaaccccgctcccccgaattcatggaagcgctgaacaacctgcatgcggatatcgccgcggtcatcgcctatggcaatatcctgcctaagaacgtactcgacgcagtgcccatgggctggtacaacctgcatttctccaacttgccgaagtggcgtggcgccgctcccgcccagcgtgcgatttgggcgggcgacccgaccaccggcgccgacgtgttcaaggtcggcgagggtttggacgatggcccgatcgtcgcttccctgaccatcgagctgaccggccgtgagacctccggcgaactcctcgaccgtctggccgaggaaggcgcacccatgtatgtggatgccttggccgccgtgggtgaaggcactgccacattcaccgcgcaaccggccgaaggcctgaaatacgcgcacaaaatcacggtggaagatgctcgtatcagctggacggacgaggccgaggccatcgaccgtcaggttcgcgcctgcacgccacatcctggggcatggaccgaactgtttgcggaggggccaatcgccgataatgacgagccggccgccaaacccctcaccctgcatattctcgccgcgcaaccggccgaccagtccaatcccaacactccggccgagcttcagcccggcgagctgaaggtgagcaagaagaacgtgtgggttggtaccggcagcacgccgctggaactcacccaagtcaaggcgcagggcaagaaggccatgcgcgccgccgactgggcccgaggcgcgcgcctctcccccgccgcctgcgtgcgataacaagcaatatcgctcccgcccggaagcacagcaaaaagcccggcatcttcgcgaggaagataccgggcttttcagctatgcaatcggcgatcagtcgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgataagcgccaccggtcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggcgcggtcacggtcgagcgaatcgaacagggtggtgtgggtccacggctccggggagatgatgtggccaggagcggccttgtacatctgctgggcttcctcggtgcaggtcgggcgcatgatgtcccaatcggccagcttggcttccagcgtcggatagtcgatggagtgcacgttggtgtgcagcttgccggcgcggtcgagctcgccgaggatgccggtgatgccgccggcgcggtgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgagcgatcttgacgacttgcttggcggcacgcttgaacaggtccttgcggtaggagtgggaggcgaggatggtgccgttgccgggcagggccaggccgatggcctcggtcaggcagttcatcgagttggcggtgaacatgccagcgcaggagccgcaggtcgggcagacggtcttctcgtaattgagcagttcctcatcggagacgttgtcgtcggcggtggcgtacatcacgtcgataaggtcggtgctcttgactgtgccgtcggcgagcaccgtggtgccggcctccatcgggccaccggagacgaacacggtcggaatgttgaggcgcagggctgccatcagcatgcccggcacgaccttgtcgcagttcgggatgcagatgagggcgtcggcgcagtgcgcgttgcactgatattcgacggtgtcggcgatgatgtcgcgggaaggcagggagtagagcatgccagtgtggcccatggcgatgccgtcatccacggccatcgtgttgaactcgcgcggaatgccgccggcttccttgatagcctcggaaacgatgcggccgaccttgttgaggtggacatggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggttctattcaagcctttgcgagggacacgccatttgtcaagagtcgaatagtggaattttcaaaaacgtaacgtttctcacagttttttttggaatacattcctctggcgagagtccggtatagggctgacagaagtccccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctctgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggtccgcaagtccggtgaagtgccgcacctgcgcccggacggcaagacccaggtaaccattgagtatgacgataacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgtcagctggtcaacccgactggttcgttcatcctgggcggcccggcggccgacgccggtctgaccggccgcaagatcatcgtcgacacctacggtggcgctgcccaccacggcggtggcgcgttctccggcaaggacccgtccaaggtcgatcgttccgccgcgtacgccacccgttgggttgcgaagaacatcgtagctgccggcttggctcacaaagtcgagatccagatcgcctacgctattggcgttgccgacccggtgtccgtcaacgtggagaccttcggcaccgagcagggtgtgacgcgaggccagatcgccgccgccgtgcgcaaggtcttcgacctgcgccccgccgccatcatcgacgagctcgacctgaagcgcccgatctacctgaagaccgccgcgtacggccacttcggccgtaccgacgttgagttcccgtgggagaagaccaacaaggtcgaggagctcaaggccgcgattgctgcggagtgatatcgactagtccaagaaggggtgtttccgctgatgccagcggaaacaccccttcttgtatatgagtctagtgctcgttcttcgtctcgctttgtccatccgtattgtcggtatcatcgatgtcgaatccgcccatgagtacgaaacgcttcaacatattggtggcgcgcatacgcaccttgaacaccggcaatgccttgtgatcatgctgctcaaagaaggcttttgcccgttgcacgtcaagcgaggaacgcagtgcatcgaaacgtccgaactcgttgatgttcgcctcgtctatacgtttggcaaggaattcctcgaccaccgatctgttgacacccaatcgatcgaccagtttgtcgacttgctcattcttctcgcgtgcagcatagcgagtgatgtaatcacgtagcgtaatgccggcttcaacctccacgtcgccacgctccacgtcatgcaggaacagttcggcgagtcgttgttcgtcccgcgagagcgcggcaaaggaacggtgtagctgcgcagacatctccgccaattccgggctattctccttgagcgccttcagccatttattgaagttggcattcatgtaatcggtatcgatgagtccggtattgatttcggtaagatagccatccaattcatatggcgcttcgggattattttttacgccatcatctgaatcaccaccgcagctgctattgccatagaacagttctttatagcgttgcgcaagaatgaggtatgtacgttcgtcgatttgaggacgcactacttcagactcgtcatgctcatcattgtcctcattcgcatcgtcagtatccgtactatcgaccttgtattctgtggtactccagtcaaagccctgcactttcgccgcttcaaggtaccggttcaactccacgaactccttggcaaacttgcgtctggcctccaccgattccggcaactgcataaggtctgattccccgttatccgagaacacgtcaagaatctcccggtaccgcgtatccatggattttacgttcgccggcaatttctgcacgaacaggtcaagcggccgatcgcccgaatacagtttcaccgctgcttcaatgaagccatgcatggtgtgcggtttgcggtagtagcgaatgacaccgaacggcttgtccggtccgaacagacgattcgtgcggctgaatgcctggatgatgctttcgtagtcgataatcttgtcgagatacagcgtattcacccatttcgagtcaaatccggtaagcatctggtccacgacaatgagcaaatcgagctgctgactgcggtttgttgctatgccgccgtacggactcttatgcgatagtcgcgacgaaatatctttcttcatcgccggccatgtggggatgatgaactctttgccgaacgcctcattgtaatcggtgatgatttcagtcagcgcatcttctttgtccgttgctccttcgttgttgtcgatgttgggatcgaacaacgccgttacatgcaacttaggtgcttgctgcttgaacaagtgataatagttgacagcttcaggaatggagctagtggcgagcatcgcatggaatttgcccgcatggctgagcaccgggaactgttcgagaatgtccgagaccaccatgttcggatgcggggaatcgatgccatattggtctcgtccaaggaaatcctcgatgccgctaatacagtttccagcgccatcaaccatcggacccatggggacctcagacttatccatgtaatgctggaatactttggccttgaccgggtcggcgagcgcatcttccgtactctccgccttcgccttgtcgagagccacggcacgtctgacttcagaatccttgtacgtggtcaccatgtacgggtcgaatccgagtacattatggtcacgaatgccgtcggcgatgctgtaccggtgcaagcaacggccgaataccatggcagtggtggaattcttcttctggttttcgtccagaatgggcgtaccggtgaatccgaagaacagcgcgttcgggaaggagcgccggatgtcctgcaacatgtcgccgaatgtggaacgatggcattcgtccacaataaagacgatacgtcgtgcagctagctgatccagccatgtctgggtgacgcctcgctcccctgctttcacgttgctcatcttctggattgaggtgacgatcagggtgtcgttgacattggtgctgttgagtttgtcccgcaaaacaccggtgttctcggtgccttgcacttccgtctcgctgtcggcaaagctgcggtactccttcaacgattgagtacccaattcaatgcggtccatgaggaacacgactttatcggcgtcatgcgaatcggcgatgagctgtgccgatttgaagctggtcatggtttttccggaaccggtagtgtgccatacatagccgccgggtcgtcctggggtagctggccgctgttcccaatcacatttcctcaccacatcagagatggcgtttgccgcgatgtactgataactacgcagcaccttaaggcatccatccgctgaatcagcgatagtgtagaagccgatgagctgatgcgccatgggaatggacagcaggcctgcggtaccggaggtgcctccgatgaacagcttccattcgtctttgccagggttttgcccgccacagataggctcattgttgtagtcagcccaatggaagtaatagcttggattgaatttgtctacacccggattagcgaagtagacggcgtcatcggggttcatggccacaaaaatctgtactagacggaacaggccggtgaacacaccttcgtgcgcatatttctcgatctgattggttgcttggctgactggtatgccacttttcttgagctcgatatggatcaatggcatgccattgatgaggagcacgaggtcgccgcgccgcgagttcaacatcttgttcttggctggatagaccggttgctgagcgatctgataagtgcttttgccgcccgcgatttccttgcggtcatagatgtagagactgacttccttgccgaaatgcgccacatcttctttgttgtcacgcgtgatagacacggtacgcccgttgacgaacgaattgagcgcgagcggcgttcgcagggtctcgatctgctcgattatctgggtcatttccccgtctgtcagcgggtatttgccgagcctgtctatgtcattgttgttgcggtacagtatgcctttccaattgtcgagcaaatcccgctcagttggatagcgcaggacgccatccttccatccatgctgcttaagcacggtgatgacgttttcctcgaacaccgattcgctatcgaatatcatgattcttctcccctttggactttccattgtcctgcttttcgcgagccgacgcgcttaagtaatccacgcccaatgagtatttcagcatccctccgcacagtcgctgatgaaactcccgcggcacgtgccatgtcgtcatatgttgctctggggctcttttctacaaaacgcagaacaattcgctgtctctcggttatctgctcattcaaaccatttaactgctcattattgtcagttatctgctcattcaaaccatttaactgctcattattgtcagttatctgctcaccacggatgaatacatgctcattttgatcgagcttggcatccggctccaacataagcgtgagcaccgtacgatcagcctcgccgaagctctcttcaatctgcggttcaggaagtcctgcattcgcccatgtggcgaacacatcgggaacacccgtaccagctcgctcgcccacatcgattaggctgaacatcttcatgacaagaccgttgcgcggatcggacaccccgccaagacgcatctgctcaacgcccgttcggatatcgcccggattttcgaacaccaatctatcgggtgcgcgtctgaccaccacaccacgcacgccatagtaatcagcgttgaacaaacagttggccaatgcctcgcgaattgccttatgcatgggagtgtcatcaacgcggaagatgccattaagtttgaaaggggtcttcagagactcggcaagtttgagattcacgcggaaaaagaaatcaaagaggttgcctgaccacatgccatcgccggaatggacacgatcagtccaacgaatcgtcggatctagagtctcctgataatcaaggaaataatgcggacattcgcgcacgatgtcatagtcgttgccgaacataagcagaccgccgaacgtaggatgaagcttaccgtcttctcggctcaccattgccgcgccaacagcacgcagaaaacgctcgtcatcgagatcggtccaagaactgccctgacgtaccgcacggaaacgattgcgatatgcccgcactgtgtctgtattgaagtcggcaacagtgagatcgtccagcactttggagtccatcgtctcgaatccctggtcccgaagcatcgccgaaatctcctgcctcgtgcaacgataatcgccctcaccgcgccggcgataggttcccgcaaagagatcgccgttgatatacacagggcgttcctcgcgcggggcacgcggaacatgaatggccaccaccatgccaccatccgcttcgagcacctcgacttccgattcgatgggcagcacggcgcttaccttggaccggttgctgaccgtgttccaaaagtcctggcgaagatgttccgcttcagttggtgtaagtccaatcggcgcgaaggtaccgtcttcgcgctccttgacaccaagcagaatgacgccgccgtaggtgttggcaaaagcggagtaggtctcccatatgctgtgcgggaggccgcccttcgcggacttcgcctcgatccggttattctcgcgatatgaggcgagcttcgcgatatcgaatagttccatggcgattcctcccctcacacgaacatcttgtcaagcaaggatttcttgatgttctgcagcaattccaacttacgctgatgaagggtgatgagggagtcgagcttagcaaagaagtcgccaatttgctgttgttcgacggtgcttggcatatacaaaagcatgtctttgatcttgccaaagtcaacactttctacggttgttccagtcttgccaaactcaagcagcaattccttgttatgcgaaataaagaactgaagtagccattctccacagcactcgccttggggcagaatgacgcgaatatcctggttaacagttgaaggtttgcgcagttcagccaccggaagggtatggcgaagaatcccgctcctcgttaccattactaaagatccggcaggataaagagtcaactcttttgcgcccttctcagttatctgagtcgtagttctatcaagataattagatttcacgtcctgggacgtaacccacagcacgtatccatcttcatagttatcgggatctgccattggcggagtatgcccgccgccaaacgttgctacttcactcaacttacgctgttcccaagggtcagtaaaaccagcaaagcgaatttcgggtacagactcaccatctttcgggaacattttttcaagcatcgatttttttaagatgacaagcttgtcatacttacgctgatgaagggtgatgaggtcgtcaagataatcaaataaacgggagatagctgcttgttcttcgacagcgggaaatgccaaaaaggtgttcatgaactcatcaacactaatgctgcggccatcgcgaatcccataagtcaccgtcgatagaccggcaatgaaatgttcggacataaaccagtgcttccagaatcgatctgaatgcgatgttggttccttcgctctaaaaaccgtgtatgcaggcgacgttatgccctcatactgcgaatgtgcgaagcccccttgaaatgacctgagatgaacaacgaagtctccgggaagcacacgcttatatccaatttcgttgctctcgtcatgcccgatatatcgaccagaatcatcgcgatatatcatgccttgattctgcgtcgctgacagaacaggcagtgtcggatggcctctatcatcaacgatttggaacacctcactggccttacgctgttcccaagggtcagtaaaaccagcgaaacgaatcgcgggaactttcgcctgttcagtcatcattcgcctcccaacagggtcttcagctcggcaataccggccatatcgaactcattgccggttagttgaccaagcatattgccaagttttgcctcagcctgttcgatctgttcgcacacatcagagtatgtggtcgaatacttgtcgttcagcgcattcaccgctgcaatcaactcatcaacagccgtctgagggagctcctcaagcttgcgctgcaatggttccacccacttggcagcaagcaagtcatcagtatgttcatcgctcagcccttcaataacggtccgggtcttttcatcaagcgctgaacggagattcttaacgttctttttgacttcacgctcttcatcaaacaaccgctgtgcactcacaagagcacggtcaaagtcagtctcgggatgcttgccgatagacttcactgctttcttcaactcagcggcaacaaaagaatcaccatcctcactgatagcaccggttgagctcttgtcgtcttcatccatattttcaagaatgtcggcaatctcaccactaatctctcttaaccgagattcatatgtaacaatttccgcaagatcagcagtaagcagtttgctttgcacaagatcgaacggcaggatatgtccagcccagccatccggcacttcgacatccttaccgcctttcttcttaacaaccatgttggcgtcaactttgcgaacggcgtcatggccctcgctctgtatggtttcaaggtcggtggagatggtcttctgccagctatcgtcaagcacctgatatgccgtataggcatctacgagcggtatatcagtcaaacgatgtagcaggtcatgtgccagaacctcctcttcggcggcaatgctcacgttggcggcgttacctaccagttcatcacgcagataggcaggataatcggtgaatacctcacgatatcgctggatataggcactcacaccagaatcagcattcactgcctcgcgaacatcttgcacagcgagcctggccgaatggccgttctcctcagcaaagagacgttggcgcaatcccgggaacacgttccaatacttaccgagcgcatcgatatcctgcttgggaatgccaccaaacatggtggaatacacgtcccaactttcggcgctttcagaggaatccacatatcggggaatattgagactgtaatcgttctgccgaatctcatcaatgctcaccaaacggctgaacttatcgatatcacgattctccgtcaccacatccacgatgcgtttgatatcgctcgcacgcagcttgttgttcttgccgtccttagcgaaatatttggaggcatccacaacaagcacatggtcatcgttgcggtgcttgcgcagcaccatcacgatagtaggaatgcccgtgccaaagaaaatgttcgctggcagtccgatgatggcctgaatatggtggttttccactagattccggcgaatagcgccttcctcaccgccacggaacagcacgccatgtggcaacacgatggccataatgccatcatcacgcaggtgatagagatcatgcagcaggaaggcataatcagccttggacttaggcgcaatgccatattcgaaacggatatcttcgcccgcttccggcggctcccagttctgggagtagggaggattagagaccacggcgtccacaaacagcggctcataggtctcgtccttcgtttcgtcggtatcgaaccatggccagtcgctttttaacgtgtcaccgttacgagccacaatattgtctggcagtatgccacgcatgacaagattcatacgcgtgagattgtaggtattctccttgagttcctgtgcgtaatacttgatgtcattcggattgccattgcgacgggccacagcctgaccgatatggatcagcaacgagcccgagccactcgtggggtcgtagatgttgatttcttcacggccggcgagatgccaggccactatttcgctcatgagctgagagacttcgctcggcgtgtagaactcaccggccttcttacccgcgttggaagcgaagttgctaattagatactcatagatgaagccgagggtgtcgtagtcctgccggctgtccatcggaatgtccttgatgaggtagatgaggtcgcggacagccttgctacgacttttttcatcggtgccgagtttggacagaccggtttgcagcgtgtcgaagatgccaacgaacacacgtttacgagccggatcaatgttgcgttcgaaagcggaaagcgcgtcacgtacatcagcgatggtgaaatcgccctggctggcaatccacgtggagaacaggttgttgtaggagatgaagtagccacatagatcacgtacatactgtacagtttcggcatcattctcatccaagcccttgaggtcttcggctccccagtcttcagcacgcagacgagcaatctccgtctccgagaggaacttatagaagataaagccgaggatatagtccttgtattcattcgcctcaatcttggaacgcattttattggcggattcccagattttggcggcaagctgctgcttattcattcatatgctccttgtttctgtacacgtaatcaagggtctgtccttgttcattgacccattcggtccaaccgttttgactgccaccgagaacaaatacagcagcagcggaagggcttgacagttcaatgtcatcagcaagagtcgccttgcccgtctgcgttccgaaaagatgctgccgagctgccacggctccctggtttttaataactggatgtacgagatccacttcagaaccggaaagaacagtgaaacgacctgtaccttgactatatcgcccagtggcctgaacaccgttcttcttcgtatggaatacggcgttcaccataaccggtgtcttttcttttcgatcaaggtcatatccgagcactcgcatacgaaagaggatgttattgtgcagtctttccacctgttgctctttgtatggattcatgcgaggagcaggagtatactcattgtcggtctcataagagccatgtttgtccacataatctatggctgttgactcaagagagtccaaaacatcacgatcgatattgacatcattatcgaggaacatgatggctttgttccaaaaatctttcttagtcttgtgcgcatcaagccgactaagccccttcgtggtttgccccacatacgcacggctcagaactccatgatcttcatcaagaagataatacacaccgcgatccggcaaatcgggaagacttttcgcctcactcaacatatcccggggcaccacaaccgtgacaagcgactccccatccacacgacaaattcgaatgccatcaggattgttgtcaataatttgtatggtcatagcagtgagagcaatcattacttgccgccctttgctagttcattaatcatgcatgttctcacgaatgccgaaaagctcatcccgcgaagagatgcggcctctttagcagaatctcgcaaattagcggggatacgcatagtaaccggcaccacatcaccgtttaccagatacgaacgtatctctgtttcaccagcatcatgctcaatcagatcggagtacgtcattgcattctacactttcaaactgcaatacaaatgcaataattctacacccgcttgggaacagcgtaagttgggagagctggcgctgacttattcaggaggcactcccagcgctggcaattctgcttactatggaggcgaaattccttttatccgatctgctgaaatcgattgcgattcaaccgaattgtcacttacggttgcgggtttaaataactcatcagcaaagcttgttgataaaggaatggttctctatgccatgtatggagcaaccagcggagaagtcgctatttcgaagataaaaggggcaattaaccaggcgattcttgccatggatgcatctgatatggcagcaaatcgtttcatagcttactggctccgtagacagaagaaatcaataaccgaaacctttcttcaaggtgggcagggaaacctctcaggcgcaatcatcaaagagctaggtattcctcaaccaagtttagatgagcagcgacaaattggctctttcttcagcaaccttgacgacctcatcacccttcatcagcgtaagcgtctatctattcggcaaaggagccccgtgtggtcataaacacaatcaacgaagaaatgtcgttctgcgattactactcgcaatgggtcgacgtctacaaggaaggcgcgattcgggaagtgacaatgaagaaatacaagctcacacaggcgtggctgagaaaacttatccctgatctcaagctttccgagttcgatcgtgtgagctatcagaaactcatcaacggatacgctgagcatcacgagcatcagacaacaatggattttcatcaccaactgaaaggagccatcctcgatgccgttgatgaaggtctgattcagagagacccaacaagaaaagcaatcatcaaaggaaaacagccgagacagaagaaggtgaaatatcttaaccagttcgaacttcatgctgtccttgctgatttgaagcttgatccgatacctaactgggactggttgatactgctagtggcaaaaaccgggttacgtttctccgaagcattggggcttactcctgatgatttcgatttcgttcaccagactttgtccgtcaataagacatggaattacaagaatggaggtggctttgttccaacaaagaatgcttcttcggtacgtaaagtacaacttgactggcaactcatcatgcagttgtctgttctgttgaagagcttacccggtgacaagcctatcttcgtggatggcaaggtatacaactcaaccgccaacggtattctggcccggcattgcaaacaagccggagtacccgtgatctcgattcacggcttgagacacacccatgcttcactcttgctatttgccggcgtttcaattgcaagcgtctctaaacggcttgggcacgcaagcatgaacacaacgcaggaaatatatctgcatgtcatccgcgaattggaaaacaaagacgttgacatcgtgatgagagccctatccacccttatttagcaaaccacagacgcttacgctgatgaagggtgatgaggtcgtcgagagatcgcaatgtcatcccgatttgctgctgttccgtttttgaaggaagcatcaattgataatctgcgtattcctgcgcattgacaccaggctgcccggaccgctgcgaggttatggcaacatacttcttgtatgcatcggtcaaggttgcctgataggcgaattcggggtcagcgccttcgccgattcgggcacggataaggaatccagcaaagtagaccattccatcgaattgcctgtacagatatgtttttcctacactcgcgcctgtgcgagcaaagagcagatcgccctctttcagtaaataatctgcactcattgcaaggtcagctaacggcgtcgtaagatcgcttttcgagaactcatgggtttcgtcatcaatgtcggtgatacgcagatatttattttggccatcgtattctgttgcagcagcgttcaagccgtaatcaaatgaagacgcaacgtctcccaacttacgctgttcccaagcgggcatcggcactacatgaagcagggcagacgggatacgagtggctggccgaacatacgcaatacatctaccggcaacttgggcactaccatttccgttgttagctacacttatcgcgataagtgtagctaacaacgattgaagcgacaccttacaagccatgagaggtagaaccgttccccttctattttgaaaaacttgaataagttagattttttcaaaatagggatgcgtcgaaaagacgcataaacgcacgaaaaatgcgggcatccgatatgcagtgttcattgaatcactgtatatcggatgcccgcaattgtttcagaccaattgaagagccttagctcagcatcagcctcacgccttggcgacctcaacggccagctcggcgccttccttcacttcgaaggaggtagccagcgtctcacgggcgatcagatccttgaactgctcgaccttggccacattggcggccggcacggtcagcaccagggcgatacggtccgcgatgtccagatcggcagccttacgtgcgtcctgcacagaacgaattacgtcgcgggcgtagccttcagccagcaggtcgtcatccagcgcggtgtcgaggatcacgaagccaccggtcggcagagcggcggagaccgaagcggcggccacggtggcgttctcctcctccacacggttgatcagctcgtactcgccttcgaccagcgcaaggtcgccggacggcgtggagaccaccggcgcaccggacgcagcatcgacatgccagtcgccggacttggaggccttgatggcgaactgcacctgcttgccgaggcgcggacccgccgcacgggcattcacacgcagctcgtgaacaatcttcagaccgtgggcggaggcatcctgcagcgtcgagaactcaatattcttgatattaagttcagacttcagcaactcgtcgtatgccttgacggcgtccacgttctcgaccaccacggtgagcttggaaagcggctggcgcacgcggatcttggcggccttgcgcagggacagggtgccggaaacaacctcgcgcaccttctccatcgcatccaccagggccgggtcgtcgaccagcacgcggccgagttcggtgtcttcaccggtcttctcgtccgccacgaacggccaatcggccaggtgcacggattcaccgccggtcaggccgcgccacacggactcggcttccatcggggccagcggcgcaagcacgcgcatgaacgcttcaagcacggtgtacagcgtgttgaacgcggacgcatcctcgttccagaagcggtcacgggtgttgcggatgtaccagttggtgagcacgtcgatgaagtcggagaccgcatcgcaggcgtcggaaatcgcgaactcgttcagcgacttctcggcggccagcaccaggcggcgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgatcaggttgccgccgcgcagaatcggcgaagacataaggaaccagcgcatggcgtcggaaccgtacttgtcaaacacgccgttcacgtccggatagttgcgcaagtgcttagacatcttctggccgtcggagccgagcacgatgccgtggcagatcacgttcttgaacgctgggcggtcgaacagggcggtcgccatgacgtgcagcaggtagaaccagccgcgggtctggccgatgtattccacgatatagtcggccgggaagtgctgctcgaacttctccttgttctcgaacgggtagtggaactgcgcgaacgacatggaaccggactcgaaccagcaatcgagcacatcggaaatacggtgcatgtgcgacttgccggtcgggtcgtccgggttgacgcggaccaggttgtcgatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacgttgccagggatccagttgatttgctggttcaattccagtagacgcggcttgatcttggtcacggacacgaaccaggaggagaccggcttgtagatcagcggggtggcgcaacgccagcagtgcgggtaggagtgcacgtagctcttctcctggaagaggatcgcgcggcgctcttccggaatctcggcgagcgggccatcgccggcgcgcaggttgcgcaggatcggcaggttggcgtcgaacacgaaatcaccctcgtagtcggggcactgcgcggtgaagcggcagccatcgtcgagcacgtcggtgctcttgatgcccttagcgttcagcgtgttcatatcgtcttcaccatagggagcctggtgaaccagaccggtaccttcaacggtgtcgacgtagtcggcggtgaagatcgtgtagccgttcgggccaggcacgtggccttcggattcggcctcgtcacccgcgaagtacgggaagaccgggtagtagcggcggccttccagctcggagcccttgagctcgcgcacgacctcgtagttctcgccgagttccttctcatagtgcggcagcaggtccttgccgaggtagaacttcttgccagcgaacttgccttcggtcgggcggacctcgacgtagtcgatgtcggcgccgaccacgatggcgaagttggtgggcacggtccacggggtggtggtccagaagacggcgtaggcgtcgtcttcatcgcgcatcttcacggccacggacacggtggtgtcctggcggtcctggtacacgtcggcgtccatgcgcagctcgtgcgcgctcagcggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggcagaccgttcgcaaaaggcgggccatcgaagaacacgaattcgttctggctgtggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgccgcccacggccacggcaccgtcaggagcccgatttagattgggaccggccaccacggaccgagaaaggattgtcggacaatgacgtatgatttcacgtccatcatgaacaggcatggcatggattcgatcgcggtcgacggactgggcaccgacccgggattcgcgccggacccgccacgcgagggtttcgacgtcatccccatgtgggtggcggacatgaacttcccgaccgtgcccacgatcccgcaggccatcatcgaacgggcgaagcatcccgcctacgggtacttctcccccaccgacgactattacagctccatcatcgactggcagtccacgcgcaacggggtcaccggattgacccgggaggcgatcggctacgagaacggggtcctgggcggtgtgatcagtacgctgaccgcgttcgccgcacccggcgacggcgtgctgctgcacagcccgacctacatcgggttcacccggagcatcgaaaacaacggctaccgcatcgtccacagtccgctcacgctggacgagcgcggcgtatggcgcatggattacgaggatatggacaggaagctcaaggagcatcacatccacgtggccgtgttctgcagccctcacaatccttgcgggcgcgtgtgggaacgttgggaaatcgagaaggccatggaagtgtacaaggccaacgattgcgtggtcatttccgacgagatttggtccgatttgactctggggaaccaccagcacatccccacccaatcggtcagcgaggacgcacgcaacaggaccgtggcgttctacgcgcccagcaagaccttcaatctcgccggactggtgggaagctaccacatcatctacaatcccacactccgggaccgcatcgtggccaaaagctcgaaatgccactacaacgacatgaacgtgctttccatgcacgcgctgatcggcgcctaccggcccgaaggccatgagtggctcgacgaactgaaggcggtgctcaccggcaacgtcgattacgcctacgactacatcaccaagcatttccaaggagtgagtctggccaaaccggaaggcacctacatgctgctgctcgactgcgagcagtggtgcgaacgccacggcctgagcctgcccgagttggagaaacgcggctgggatgtgggcgtcgcatggcaggacggcgacatgttccaggccccctacagcatccgcgtcaatctcgcattgcccttgagccgcgtcaaggaggccatgcgccgccttgaccaatacgtattcaacgcgtaaacggcatgcatccgcgattgcggtgtcctggaaagacgaatgccgtcaacgaggttggtgcccgttggcggcattcgtcatacgttggccgaaccgggcgaaacccaagttgccaagttgccgtgcgctatgaggtggatgccgccagcggacgtgtacatctgaccgcccgatatgccggtgccaccgatgcgccgacgctgccggcattcggattggaatggacacttcccaagcagtacgagaacctgcgcttctacggccttggccccgaggagacctatcgcgaccgtctgcacggtggcaagctcggcattttcgagcgcaccgcggccgaagacaatgcaccgtatctggtgccgcaggagaccggcaaccatgaagacttgcgttgggccgaagtgcttgacgcccaaggacacggcatgcgtatcagccaggccggcagcgaacatttcgcggcgagcctgttgccgtacaactcgctcatgctggaagaggcgacccaccagaacgagttgccgccggtccgtcacacgttcctgcgcctgttggccgcgcaaatgggcgtgggcggagacgattcatggggcgcgcccgtccatgagcagtaccagctgcccgccgatcgcgcctacacgctcgacgtgaatctggaactgttctaacagcgataaagaagctccctctgacgagggagcttctttatcgcacagagggagcttctttatcgtgctggtacgaaactgtcacgcaccactagggtggtggagatgaaggtatggtggtgcagcgtgcgccgactggagatggcctcggcaagcatcgtaatcgcagtatcggccagctcattctgatcgatatcgtaactggtcaatgtcggcgaagtgtactgggcgatggcctggttattgatactgatcacactggtatcgcgaggcaccagcactcccgcagcaataaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgtaccgaatcgaacaggctgggcgcaggattgatgtcgatgaatacgccatagggcaataccagatggagtttcaacagtttatccgaagagagtacggacggtccgatggaaatgaagccgtcgaaatcaccggcgttggcaatcagatcgtcgatatgggaaaacgacgtgagttccatgtgctgggctctggcattgtcgccgagcacggaccgcagttcatcgaaataggcgtccgccagttcttcctcgcgggtggcgttgtcgagtacggccacacggcgtggcaatgcgatacggcgtgatccggtagcgtagccaagctgctcgctgacctcgatgatgcgacgtcgcgtctcctctttgacggacaatgtcgggtccccattgagcagccgggataccgtggcctgcgagaagcctgatttctgcgcgatttccttcatcgtgaccatgacatcatcccctcaatgcaaacattacgtagtacttcagtaaattactttactacttagcgtaacgcgcaaagcccgcaaccggaatacaccggtcacgggctttgcgatatcaatgtcacatcagcagacgatatgacctgatgtcagctctcgtcttcggcgacgcgggagcggctgtagatcatcttcatcgagcagatgaagataaccatcgcacccaggacgatgatgccgccgaccatgaagacgttggcataggtcgaggccggaccggattcggtgccgaacagtgagccgccgctcatcgcgccattggccatgagctggccgaagatcgcgacaccgaccgaaccggtgatggcctgcatcagatcgttgaagcccaatgcacgtccggattcctcggcctccacggtcagcgttgcggtatccacaatcggctggtagaagaacgaggtgccgaagtagtagatgcacggcgccacggcaagagcccagatctggcccatcggaatcaggaacgcaacggcgatcaggccaccgcccatgcaggcgagcgccagaatgatggaggccttgcggccgatcttctggatgatcgggccagcggcgaagcccatgatggcggcgaggatgatcgaccacaccagcaggttggagacctgggaggagtcgatgccgtacacgttcaggccgatggcgttgcagccggcgttcagggtgtagctgaagaagtagccgacaaagatgacgatcatggtcatcgcgaaggccgggttggtgagcatctccggggtgatgaacggatccgcggccttgttgatgtagaccacgaaggccacgccggtgaccagcaccgcgataccccagaagatagtcatgtcggtgaagaacatggtcaccgagccggcgaacaggccaatgagcgtgaagccgatcacgtcgatgcgcgcgcccttggcatgctcgtcaggcaggttcttggccaggatcgggatgaagaacaccgcgatgatgccgataccgaagaggatgcgccaatcgacaagggtcatgtagccggcgaggaagacgcccagagccgcggcgatacggaacacggcgacgaacacgccgtaccagatgactcgcttcttcttctcgatgtacttggagacgagcaccaggaagatggagccggagacctgccagcctgcggactgcacggtacgggcggcgatgacgatccagatgctcaggtcgccgaagcagccgaggatcgaaccgagcacgaacacgatcgtgccgagaatcatcatcttcttcagggacacgaagtcaccgagagaaccgtagatcacgcacacgatgccgagcacgatgcccggaatcgaggtgatcaacggggcgaggttggcctggccgagctggtcgccgatgttcacatagatcatgccgaaagcctgctgctgcagcacgcccatggtgaagatgatcagtacgatcggaatggcgatctttgccatcttgttcatacgggcaaactcttcggtgccctcctcaggcaccgggataccgttcgccttctcctcgacagcggtttctgccatggtgattcctttctattggtttgagtttggtggaatgccttatgcgcgagcgcaaggagtaaaaacagctacctcctctcgcatgggaatcgacggcgccgcgcctcttctggataccgcgagggccgaggccttcgcggcgaaatcaagtgcatgggcgatgggttcgccggacatcaggtcggcaaggagataaccagtgaaggtgtcgccggccgccgtggtgtcgaccgtgtcgacgagataagcggactgcgtgacgacgtggtccccacgcaaatacatcgaaccgcactcgccgagggtgagggctatatccgcctgggagaaacgcgcacgcatcgcacggatcagtgtctccccatcttcttcggcccctgtgagcatcgccgcctcgccctcattgagtacaaaacagccgatggcatcaagatcgacttcgtcgagccgcgagtcagccggcgagggattgagcacgatgaacatgccgcgggccttggcgcgggacacgatatagggcagttcgctgatttcgttctgcagcagcagccaatcgcccttcccatacccgtcaagcacctgatcgacgaaatcacggtcgatggcacggttcgcgccggggtacagcacaatgcagttgtcgccgctggcatcgttttggatgatggcgttgccgctgcgcacatcatcgcgcactaccaccgaggtcacgcccaccgcgcaggattcgagcaggtcgcgcaggaacatgccgtcccgtcctacctggccggcatggtgcacatcggcgccggcacgagccaatgcgatcgattgattcagtcccttgcctccggggaacacgtcgagcgcatgcgaggtgatggtctggcctttggccgcaaaatgatccaccccgtacacatagtcgatgttcagcgagccgaaattcagtatgcgcatcaggactcctttcccatgacgggaccggtgacagccagttcgtagatgcgacggcaatcgtcgcgatcaaggcgggcaatggacccgatggtggcgtccggcccgtagaaatcgatgttgtccaacatgcgttcgatgccgtcgcccggcagatcgaagtccttgaaggaaacaggcatgcctagcgagcggaagaacgattccgttgcggcgatgccacgccgggccagttcggtttcgttcatcgagccgggcctgatgccgaatacctcagtggcgtatcgcgcgaaacggaacggggccttctcgctggccacgcgcatccaagatcccatgatgattgacagggtggccccgtgaggggtgtcgtatagcgcgctcagctcgttggcaatcaggtgggtggaccagtcctgttcacgacccacgccgagggtgttgttctgcgcgatggtggagatccacatgatttgcgctcgcaagtcgtaatcggcaaggtcggccaacgatttcgggccgacatcgaccaaggtgcgcaatgcgccttcggccatacggtcgattacgccgatctcgttgtcggcgctgaaataccgttcgcagatgtgggagaacatgtccacaatgccgcaggcagtggggaacgccggcaccgtgacgctgagttcggggttcatgaacgcgaatgccggccggagtactggttcgctcagcgtgagcttggaatgctcatgctcattgttgatgacggcgacctggctggattcgctgcccgatgccgggcacgtcagtaccaccgcgacgggaagggtgcgatctaccggcactttgccggtgaaataatcccatacgtcacgctctccggcggctcccagcgcgattgccttggccgaatcgatgacgctgcctccgccgatggccacaacggcgtcgacattgcgggctttggcgatggcgatgccttcacgcaccagcgtcagtcggggattcggcttcacgccgccaagctccgtataggaaatgccggcccgtccaaggctgcggcgcacggcatctagcaagccgctggtttccagatatgctccgccatcatgatggatgagcacgcgggaaacgccctttgcgcccagttcgtctcccactttggtttcggcgtcgcgcccgaaaacgaaggtggttccgatgcatatggtgaaatccctcatatcatgctccttgcgtgtatgacggtgtccgtcatgatgtcgttgagttccgcgatgtcgtgcgccacatatgcggggtttctgctgagcaacgcgatttcgtcgccatccccgtatgtgaccgctatgcaggagatgccgttggtccgtgcagcttcgatgtcgctgaaggtgtctcccacatagaggcattgtctcggcgcgatgccatgccgtcgaacgatttcggctatcatttcgaccttcgtcgcctcacggccgggtatggaatcggggcagatccaatcgtcgaacaggttcgcccagcctttgctgccgagtatgcgcctcaatgcgccctccggcttgttggtgacgatgatattgcgtacgctatgtcccttcagctcattcagcatgctctgaatgcccggatagagtctggtgcgcgaaaaatcattgagcgtgcggtagtgtacgcgtacatcctcatcaaatgtctccagatacgcctccccgggataggggatcacgtgccgcatgatctcatccatcggatcggccagattggcgtcatcgcgcatgtacaggtcatcgatcgccccgcccgcacgacgcgcggcgtacgtcagggaattccacacgtcgctgccagtgtcggcaagggtgccatcgaaatcccataacaggcatcggtactccattggattgctcctttcgttcattcgcatggcggtggtcgatgattggaggcgagataccgccggccggccagaaggggttggagtcgccggccggcggtggagggggttgttcaggggcaagactcagtcgtagttttcgagggtgctgttcagtaggtcgacgaatccggggaagtcgagttccagcgcggcttccgcattcggctcttcgccgcgatagcccatcgtcggcgtgcgttcaagatccacggcaggcacggtaccgcgcagatgacggtagtcgcacacggtcataccgcgggtaagtgcgccgtgcagctcgatatcgatatgcatcgggaccgcagtgatcagcgacgggtcgataacccatgccaccgcgcatgcgtcgtgcatggtggcgcccgtcagctcggactcctcctcgcatgcgccgatgaagaaatcggtcagatcggcggccaggttcgcggccttggtgccgatctcacggaacttggctacgtgcttggcggtcagctcgcattgacgggtcaggttgatgccagtcatcttgacgtgcataccggagttgaacacgcgcgatgccgcctcggggtcgacgaagatgttgaattcggcggcaggggtccagttgccgtaggtgacggacccgcccatgatgcacagctccttgacccgttccacgatgcgcggctcacggttgatggcggaggcgatgttggtcagcggaccggtggcgatcagcgtcacgtcatccgtgctcattacggtgtcgacgatgaagtcgaccgcatgcttgttctgtgcggcgtgcgtcggctccggcagcacgggaccgtccagaccagtctcgccgtggaactgcggtgcggtgaccagcggtgcgaccatcgggcagctgtgccccggatatacgccgatgcggtccgccacgccaaggacctcaagcaccttgatggcattgcgggtcacgttctccagtgtgcagttgccgccaatggtcgtgatacccagcacgtcgaggtgctgcacggcgagcatgatgccgaacgcgtcatcgtgtccgggatcgcagtcaaggatgaccttcttcttgttttccatagggatacctccgttggttgtgttctttggattggtcgatattcgggcatggcgttcagccggtttgcccggcgaggaactcgtgcagctgtgcagcgtccggcgaggaacgtgccccgcgacgggccactttgtatgcggagacggcattgccctctcgcaatgattcggcgagggaggctccggcgagtctggcagcgatgaaaccggcgttatagacgtcccccgctccgatggtgtcttcgacgttcacccggaacgccgggctttccgtcaggccgtcttgcgtaagaccgatcgatcctcgggcgccgtcccggacgatgacggtccggccgtccaccgcataggccgtggcgttgcccatcatgtcgtcgtcgcctaaataggcgaactcgtccggccctgatcccagcagataatcgacattcggaataatgcgttcgagtgcagccgcgaaatcggggtcgagcacgccgtcgtccacacgcaggttcaggtcgaaagatgtagggactccggcatcgtgggcctgttcgaagatgcggatgatcgtctccctagcgctggtgtcgtaggtcaggcacatgcccgaggagtggacccaatccgcctcacgaatcatgtgcatcggcacaaggttttcgtcgagcaccttgaacgattgccgttcgcgaggccatccccacaggtacctctctccgcggtcgtccacgaaagcgaatacgccgaccgtgctcagggtcgaatccgcaaccagcccggtcacgtccacgcccgcatccttgaagtcctgcataacgaaacgcccgtactgatcatctcccacggtgcccacgaacgatacatccaggccgagcttcgccaacgccacggccgtgttcgccgaggttcctcctccctcgatgccgatctgcggatattcgacctgcgtgcgctcctcgttgagaaaacgcggatagggcacgatgatatccacattggcatcgccgacgacaacgaccttaggcatctttggccgccttgataaaagcctcgaccttggccgggtccttgcaccgatccgtatcggcgcgatcatcgtcgtaattggtcagggagaacgagtcgacgccatacgggtgcgtggcataaatcgcctcggccacattggaggcgtccagaccgccggcgatgatgcacggcacgtcggtggcctcgatgatggcccggtcgatggcccggtcatgggtcaggccggtcgctccgatgtctccggcagcaggtgctttggtgtcgatgaggaagaagtcggaaaccggctcatagtccttcacatactgcatgaccttctgttcgtcgagaggcactccggctagcaccgggatggcctgcatgatcttcagttcggggaaccggctcttaagttccgccacttcggccggactgatgccttcgatgtcgccggacaggtgcaacacgtcgggcatggcttcgcgcaggttctcgctgatttcgtcgatgtcttcggcgacggtcaggcctatgcgcacggcttgtggttgcacgccttcgaagatttccctggcccgttcgcaatcgagctgaccgggcgtccgcttgattttgccgtaggagacgccgatatgttcgccgcccatgtcgattaccatgcgagcgtcctcgacattccttattccatagatttgagcaatgacatcagccacgatggttcctttcctgagcaatggcgttgatgaacgcggggacggagaataccgtctccttgaggcctgcaccctgagccactcgggtgacgggcggcggcgtcacgaaggaacgccgaagtgtgtcggtctgggcaaacacctcgcgggcctggccatcgagcagcacgcggccgtggtacatcacgatgacacgggagaagttcgcggtgacgaatttcatgtcgtgcgaaatcgtgatgcagagtctgccttgtgctttcagacgttcgatgatgcgtgcaaggcgggcgttgcccgacgcatcctgaccgcacgttggctcgtcgaaaatcaccacggatgggtccatcatgatgacggcaccgattgtgcagaatttcttctcggtgggcgtcaggtcgaatgggtgcacgtcgagctttttggtgaggcctaccagctcggcgatgctgtccacgcgatgcgcgatgccctgatcgctcatgccgatctggcgcggaccgaattcgaattccttgcggacgctttccagaaacagctgatcgtcgggattctgaaagacatagcccacgctgcgagaccattcggcggtgctgcgctcattgacgtcaatgccatcaatcagcactttgcctccggtggggcgcagaatgccgttgaaatgcttgaccagcgtggtcttccctgcaccgttctgccctatgatcgccaccggctcgttgccgtcaagtgtcaagtccactccgtcaagggccttgtcacctccgggataggcgtgctccagtgcctgcaactcgattttcatgagagcgcctccttggccatgcggatggccggctcctcggtaatggcaatcgggccaccgagcgcacgggtgatcttcacgtaatcgggcacttccacgccatgctcttcgatcgccggatcggagaacacctccatcggagagccaagggccacgacttcgcctcgctcgagcaccatgacggtatccgcgtatcgtgccactcgctccatgtcatggtcgaccatgatgacggtgacgccgtccgcattgagctgtttgacgatgtcgaaaatctcctcgctgcccatcgggtcgagctgcgtggtgcactcgtcaagcaccagaatgcgcggttccatgatgaaagtggatccgaaagccacacgctgcacctgtccacccgacagttccagcgggttcttgtctagaatgtggtcgatgcgcatcaatttcgccacagcttcgacgcggtcgatcatctgcgctctgggcacaccgtggttgcctaatccgtaggccagctcttcggcgacggtcccggcggtgtaggacagctggttgaacgggttctgaaacaccaggccgatggtcttcgacagttcggcgatggtcgaatcggcgacatcggtcccgtcaattaggatgtgtccagcccccgcccccacgaaatagtgcgggatcaggccgacgagcgcattgcataacgtggatttgcctgccccattcgcgccgatgatggtgaagaagctgccttcctcgacctggaagtccacgtgtttgacggcccgacgcttggtgtcgcggtacttgaaggagaaatccttgacctctactatcggactcattcacttgcctccccacgagaccggcaacggaatcacaccgatgcggatgcatacggaaacggcgaccacggcgatcagaaacaggacgaagatccaattgagtaccttgtcggcggcattccagctgaccttgacataactggtctgcttcactccagtaatgccgaagccgcgagtctccagggtcataccccgctcttgggcgtcggtcagcgatgacatgacaaccggaccaagcaacgggatatacgccttgatgcgggcgatgaccccacccgatgcatcgagtccgcgagcggattgcgcctcctgaatcaccgccatacgtcgttgcatctgcggcacgacattcaggctggcgagcaccaggtatccgaccttggcgctgagccccaccgaagtgagcgcggataccatagcaccgacataggtggttttgttcatgatgtagaagctgccaagaaacaccagcaggctcaccaccactttggccgcatacagcacgccttcgagccccagttgcgcgaagccaaaatccagtaatgcggtacggttcttgggactgtacagcccttggatgaacatgagcatcacagtgacggggatgccgaaaccgaacattatcttggcgaaatcacgctgtatatgagccaagaacgagaccacaagcagcaacaccacgagtatcagaccaagcgtgaagtcaggccatgccaatgcggacagacccaaggcgaacacggccgctatcttggtgatcggattcagcttcccaattacggtgtcattgatgaccggcatatgcgacgacatgtcttactcgtcttcttcttcgtcatcatcactcagcgcatcattgtccgagccgcccatggagtcggccgcatactggctgagaaagcgacggggaatcttctgcacgatcacccacgcgatggcgacagtgatgcccttgtcgaggaggttctcgatcagcgacgaggagatcaccgaggcgagaatgtctttcatggccacgaccagcgttgccgtcagcaccgatgtaccgttgacgccggtggcaccgccgtatacgaatgtggtgatcagcgatgcggagatcgcattgacgaacgtgcacaccagccagatgaccacgacgccccacttcttgtggaacagtccgggcttgaccatatagccgacgaccaaaccgcacaataccgacaccgccgcatagggaagatagaccgggttggctaccagtgccaggaaaagattggtcagcaggccggtcagggccgcaacccatggtccagacaggcatgcgacgacgatggtgccgatcatgtcgaggaacagcggcagcttgagtgcggagcacagagttccgccaatgagattgattccaaccgcgatcggaatcagcaccaggcactttgtggagaattgtgccttgatcccttcccagaacgacagcttccttgccatgctggccctcctttattttccaaccctcggttttccgcagtgtgcaatctacattgtttgtcttgcggaatcttaggaaatcattttcctaaaatgttttcttgagataagattataggacgccaacgtcagtgtcaacacggcgggtcgagggtcaagcaacccggaccgaacggcccacaatggcgacgtagcaaggaacagaacgctacgcccttgtacactgatacagaggaaaacaggcaggaggggagacatgaacatcagggacatcgcacgcatcgcgggcgtctccacctcgacggtctccaaaatcgtcaacggcaaggattccagcatcagcgaggaaacccgcaagaaggtcctgacgatcgtcaaggaatatcattacaagccatatgcctccgcctcacagcgcacgcgtagctacaccatcggagtgctgctgcgctcccccatctccttcgatagcacgctggacggcatcatccaggccgcccagaacgccggatacgcaaccgatgcctacaacagctattccgatccggaacgcgagctcaaaaacatcgcagcgatatgcggccgcaacgtcgacggcgtcatctgggaaccggccactccggacagcctcgcctatgcctcgcaattccccgaaagcaccccactgctgaccataggacccaacggcggcgaccagtcactgctactgccttataaagaagcggcctacaaactgaccagcgagctcatcgaacgggggcaccaacacatcgcctgcctaatgaccaagggacgccgcacgcaggattttctcgaaggctttcgctcctgcctgttcgatcatcagctgccttatagcgacgatctggtctactacgacctcaacgactcgctgcccggcaaaatcggaagccgggacatcaccggatttgtctcctcgcattaccggcgagcactcgagttcacgcagatgatcagccccctgcattaccggcttccagaggatgcttcacttgtctccatcaaaaacgacaccgccgaagcgctggcctatcccggcaacacggaaatatctacctacaccatccgcaactccgacttcggcgcctacctctgcgagaagctcattgcgcagatagagcacgacaaagagcagcatccctcgttcgtacaggattttcatctcgacaacaccagcaccatcgcagccccgcccacttccgccatcaaacatgtgttggtcgtcggcagcatcaatattgaccactatctgtcagtgccgcggctacctcatatcgggggtacggtatccaccaaatcggcggcgcgataccccgggggcaaaggggtcaatcaggcgatcggcgcagccaagctcgggcaccgcgttacccttatcggcaatgtcggcgtcgacaatgggtccgattacatcttcaaggcgatggaacagcatggggtcaatacggccggtgtgcgacgctgcgccggagaggacaccggctcatcgttcatattcctcgcccccaacggcgaatcggtcatcgcgattctctccggagccaacgcgtcgctcaccccggatgacatcacctccaacgaacgcctgttcgacaatgccggatactgcctgatacagaccgaaataccgttggaatcagccaaagtcaccgcgatcaccgcccgacggcaccatgccaaaaccattatcaagccctcgtcatgcgactatctgcccgactccatcgtcgccaatgccgacattctcgtgccgaacgagcacgaactggcgatcatcgaaactgagggaaaaacaatggaggataaggccgcgcatcttctcgaacgcggcgcgggctgcgtcatcgtcacccaaggagaacacggctgctacctgcgcggccagaatgtcgagtgccactatccggccgctgacttcacccccgtagacagcaccggagccggcgacgcgttcatcagcgcgctcgcctcgtatctgatgtacggatacaccgtgcggcaggcggtcgaaatcgccacctatgccgccgggtactcaatcacccgcaaaggcgtcataccctcgcttatcgaccggctctcgctggacgcctacgtccatcacagcgaacagtagcggcacgggtatctgtcttaaggcagtttccaccgcagacaattaaggggaaccgcatctagtctgcggctcccctcagtcagcttcgctgacagctcccctctctgaggggagccaaaaagcactactccagttccactgcaccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagatgccgtcgtacagaatctggccgtgctggatgtcgtagaaccggttgatgaggttggtcacggtggtcttgccggcaccggtggcgccgacgagcgcgatcttctggccgggcttggcgaaccaggtgatgtcgtgcagcaccggcttgtccgggttgtagccgaaagtcacgttggtgaaacgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggttcgtccatcagcttgaagatacgggaggcaccggcgagcgccatcatcaccatggtcagctgctgggagacctggccgatcgggttgatgaacgagcgggatagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtattctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaacggaatggacagccacagcatggacagcagcgccgcgaccgcggagataatcgaggagaacatctgcgggaacgactgcgagatggcctggcgcagcgtatcggtgtcgttcgtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcacgccatcaggctgatggcccgcagcagcggggcccagtcggggttcgactcccccaccatcggcagaatatacgtatcaatcaacgactggaggaacagcgcggaaccggcctgcgcggcggcaccgaccaagatgcacaccacgatggcgatgacgcgccacttgtactggaagatgtagctgaagatgcgcttgatggtgccaggctcggctttgcccatggcgggcttgcggttcttgaaactctggtcgttgctcatcgtgcttctccttccttggtatcggctgcattggtatcagctgcgctggtatcggccgtgggcatgggcactgtcaccgtcacggtttcggacggctcagcggtagatgactcagcagcctgttcggcagcagccagttcttcgggctgggcctggttcttggtctgggattcgtagatggaacggtattcatcgcaggtgacgagcagttcgtcgtgtgtgccggacgccatgatgcggccggaatccatcaccagaatcatgtcggattcctgcacggaggccacgcgctgggcgatgatgatcttcgtggtgtccggaatctcgttgtggaacgcggaacggatcagcttgtccgtcttggtatcgacggcgctggtcgaatcgtcgagaatcagaatcttcggcttcttcagcagcgcacgggcgatgcacaggcgctggcgctgtccgccggacacattggtaccgccctgctcgatgtacgtgtcgtacttatcggggaattcctgaacgaatccatcggcctgcgcgagctgcgcggcatggcgaatctcttcatcggtggcgttcgggttgccccacctgaggttttcggcaatagtgccggagaacagcacgttcttctgcaacaccatggccacctgatcgcgcagcgcctcgagatcgtagtcgcgtacatccacgccgccgaccttcagcgaaccggagctcacgtcgtacagtcgcggcacgagctgtaccagagacgactttgccgaaccagtaccgccgacaatgccgacggtcatgccggagcggatcttcaggttgatgtcgtcaagcacgggcttttcggaactgtcggagtagcggaaggtgacgtggtcgaattcgatggagccgtcggccatgtcagtcaccggctgtgccgggttctgcaccgtgctttcctcctgcagcacctggcagatacgctcggcagaagcctgagaaataatcaccatgacgaagatcatggacagcatcatcatggccataaggatctgcatggcgtaggtgaccagtgcggtcaggtcgccggtggtcaggcccacggcggggttgttgccggaggcgacgatctgctgtgctcccatccatgcgatgaggatcatcgaaccgtagatgcagatcatcatcagcgggctgttgaagctcatgatgcgttcggccttggtgaagtccttgaagatgcgctgggagatgcggccgaacttggagacctcgaaggattcgcggttataggacttgaccacgcggatgccctgcaggttctcgtcgaccacgttgttcaacgcatcgtaggtgtgaaacacgcgctcgaacaccggatgcacgagcacggccagaccgcacaggccgatggccagaatcgggatgcaggccaggaacaccatggaaatcgacggggagatacggaacgagaacagccaggccacgaccaccatgatcggggcacgcacgcccagacgaatgatcatcatgtaggcgttctgcaggttcgtcacgtcggtggtcagtcgggtcacgatcgaaccggtggagaaccggtcaatattggtgaagctgaagccctgcaccttctcgaactggtccttgcgcaggttcttggcgaagcccgcgccggccacggccgcgtactttccggacaggaagccggcacccagcgaaaccatcgagcacaccagcagaatcacgccgaacttgacggtggccggcatgctgccaccggtgataccctcatcgatcagcgaagccatgatggtcgggatcaggatctccaggatgccttcgaccgtcacgaacaccggagccaggatgctggctttcttgtattcacgaatcgactggcccaacgtgcgcagtacatgtttgggcttgtccggttcgacggctttgcgcgcctgcgcgattgcctctgcggtgtcgctcattcgttctcctccttcgtgttagcaacctctgctccgtcttgatcgggagccatcaccacaggtgactgagggagtgtttgatgttcaaattcgcgttgtgcgcgctcgatgttcgcacgcatgcgtgcgacgtagtcgcgcagagcggccttctctccatcggagaagccgccgaccagcaaccgttcgacccgatcgccgttcgccttgagatcggcgacgatcgcgtccgccttgtcggtcaggacgatgcgcttgcagcgcgcgtcatgctccaccgattcacgggcgatcaggcccttcttctccatcagggccagcacacgcgaggcggtggaccgggtgatgcagaatttctgttcgatggtgtgctggtatatctcacggccgcggttacgcgccaagaacatgatgatatgcgcgttgccgccggtggtttccctggcggtttgcggcatgctctcgcccaaatagcggtcgacggctttggttaccgcgcgcatttcgatgctgagaatatgctgatccattgtcctccgtaccatgcgggggccgtgtgcgtttgtaccttcaccccacattgttgtatacgcaacaattcatgataaagagacctatatacaacagttgcacatacaacaatcggcgtgttgtagtatctccaaacaactgttgagcctaaacaaagctggctcccctcaggagagggaagccagctgtattacgccgtgcgattgcctcgcttcagcccttacttcgcgagcttggcgtactcgtcaaccatgaactgggcgatcttcttgccgccttcgcccagcagggtgggcagcgagttgatcggcatggggttgaggaacatgcgcatcatggcgttgtcgggcagcttcgtcagctcgccggcctcgccggcggcggccacggcggccacgatcttggcgccgaacggatcggcctcccactcgccgtaggtggaccattcggtgagcggctgggtcttgccgtcgccatcgagggccacggcaacggtgtcggcaatgtcgcgggagctcacgcccacttcgatggcatattcgccggcctccacgtgccagtcgttgtatttttcggaccagtaggcgaacgcgcgctcgtcgaggtcgatggtcacggtcttggattcgccggccttgaggaacaccttggtgaagcccttgagctcgtgcttcgggcgggccacgtcggccttgcccggagccacgtacacctgcacggtttcggcggcatccacatcggaggtgttggtcacggtggcggtcacggtggcggtgttcgcgccggtcttggcggcggcgacgtcatcgatctcgaatgtggcgtagctcaggccgtagccgaacgggtagtccacaaccttgccgtaggtgtcgtagtagcgatagccgacgaacacgccctcgccgtagtcgacgtggccttcctcgcccggccagttcagcgtgctcgggtcatcgctgatgtccagcggaatcgactgggcgagcttgccggacgggctgacctggccgaagatcacatcggcgagcgcagggccgccggcctggccgagcagacaggattcgagaatgcccttggcgttcttggcccacggggccacggagacgacggagccgttggacagcacgaccacgacgttctggttcgcggcggcgacctgttcgagcagggcgatctgcttggcgggcatgtcgagggtttcgcgatcgaagccctcgattcaaagcatccggcgcacgactatttcgcggaccgcgagcgccgcagcgtgacgaacgcgctcaacatcaactggtcagtacccgacggcgcgaacgtggagcacgtgcttcaggcgggcctgtcgatgatggacggcattcagctgcgctggctgcgctctcccggtcgcgatctcaacgccatgtgggtcgactgcgaggatgtgctgttcccctcccccttatgggacggataccgctgacccttccgtaaatcgcgcgtctcgcacatcacctccgccaccgcgtcatcaatcaccgtcatcccgaaccatcaccccatccatcccgcatgccagacatgccgcagatcccaagggtcgaggcgcgtgtcgtccatcacggcggcgtccccgtcacccataccgggcgcgggaggcgcgagacggtcaaactcgccgcgaccgccgcgcagtcgatagctccagtagacctgaccggcggagacgttccacgcgtcgagctgcatggcggcgacgcggaggtagacggcgcggcggcgcgcggcgggcgacgggacgccgtccccggcgtcgcccgcgcgcgaaccgacgtcaccggatgcgccgtctccaacatccgcaccgccgtcaccgaacgcaccatatccgtcgaacgcaccaccagacgcatcaacggacgcgacctcaccttgcgccccgcactcccccatgcgcgccgcaagcccgttcgccacgcaccactcccccaccatgaccggcgtaaagcgcgcggcacggcggatgcggcgcgcgccccacgccgcgaacagccggtaccagcgcataagccatgcgtccggcagtatgcggaacagcacctcgggccgttccgacatgacgagatacgcgtgcgtgtcgatgatgacgccgcgcatgccctcacgtacgaaccagccgcgccagcggttcaggcggaatccgtcatggaacacgatgaccggcccgtcgcccagcaccgggcgcagccatcggtatgccgcccgatagaaccgtttgaggaagcgcatcggaacgtggccgctcccccgcgcctcccccggatccttcgcccgggagctcgacggcgacatgagataagtgagacggtcgaccggctcgttgagcacttcgatgccgtacaacgcagggcggtcgcggtaacgtcgcgcgagacgctcgagcacgtccagtgcgaacgcaacctgccgcggcgtcgtatgccagcggaccacgccggtcaggccgccattgtcgaacccgttctgcgacccgggcacggtgtgcaggtcgatgagcaccttaagcccggccctctccgcccagtcgaacgcacggtcgaggtattcgacgcatccgggatgcccgggcacgtcaccgaagatgaaaaacggcacggggatgcgcacaaggttcagcccgtgcgcggagatggcgcggaagtcgtcctcggtgatgtacgtgtcgcggtgacggcgcagcaggcgctccagttcggccgggtccgtggaccggtgcagccagatctcgtcctcctcgccgctcgcacggaacaggccgggcgtcatccaccgttccaataccagccagccgccgaggttcactccgttgattcgcccatcgtcttccggcatggccctctcatcagtattccgcatcattgctccgttccgcacaaacgacaccgcccgctccagcatacgaccggagcgggcggaaacatatgaggcccacacgaaaccgattcacacgggaccggctcacgcgagagcatctcacgcagagcagattcacgcgacggtgaaggtggtgcgcttgaggtcgtcgcggcgcgacgagtggccgatgagcagctcgaactcgccgggttcgacgatgcggttcgcatcggcgtcggcgatggtgcagtcgcagaccggaatgtcgaacacgacggtcgcggtctcgcccggttcgagcgtgacgcggcggaacgccttgagttcgcggtcggcccagctgtatgaggtgacgacgtcgcccacgtacgcctgcacgacctcggtgcccgcgcggcgccccgtgttggtgagggcgatctcggcgtgcacggtgtcggtctgcgcgaacgtgccgtccgcgttcgaggccccgccgacgatcgtcggctcaccgtacgcgaacgtcgtgtagccttcgccctcgccgaacgcgaacgccgggtcctgcgtaaggtcggcgtagcggttgccgtgctggccgcggatctggttgtagtagaccggcagctggcccgcgtggcacgggaaggtgatcgggagcctgccggacgggttcacctcgccgaggatgatctcggcgatggcctgtccgccctccatgcccgggttcggcgcccacaggatggatccggcgccggacttcggatcgttgcaacggccggcgagcacgccggaatcgcccacgatggaacgcggcagcacctgtggcttggagctcaccagcacggtgaccatcggcttgccggtctcgcgggagacgtcggcgagtgcgtcgagcagcgcgttctggccgccgagcagttcaagcgtggcggtggaacaggtctcgccgaccagctgcaccacatcgcccacgacggcgacgatgaggtcggcctcgcgcgcggcggcgacggcctcgtcgagcagggcccggtcaacgggcgcgctcactccgatcttcgggcgcggctggccgtccgggtagaactcaccctccgggccgggcacgaggtcgatgacgttggcaccgcgggcgtaggtaacctcgcatccgtcgccggcgagcgcacggaagccgtcgagcacggtggtgatcatgccgcgcggatgaccgtcgggcatccagccgacttggccggagctgccggcccagtcgccgagctggttctgggcgtcgtcggcgagcgggccgaccacggcgatgcgcttgcgcgcgggcgcgtcaccggagccggggatcgcttcggccggcgccgcgtcgaacggcagtccgccgtcgttgcgcagcagggcaacggcctcgcgagcgagctcgaggttcacgcggcggtgatcctcggagccgatgacggccttgatgcgcttctcgtccggcagacgcgggtcctcgaacaggccgaggcggaacttgagcgcaaggatgcgcgcgacagcctcgtcgatgagcgactcgtcgagcagaccggtgtgcacggcctcgatggcgccgtcgtagaaccccggcgtggtcatgaccagatcgttgccggccttgaccgcgtcggcggcggcgtgcacgtagtcgggcttgaccttctgctcccatacggaacggcccacgttgtcccagtcggtgatgagggtgccgttgtacttccatgcgccgcgcagcttgtcggtgagcagccacttgttgaacgtgaccggtacgccttcgatggactcgtagccgagcatgaacgtgccgcagccctccttggcgatgcgttcgaacggcggcaggaaccaggattcaagcttgcggtggctcaggtccgcttcggaggcgtcacggccgccctgggtctcggagtatccggcgaagtgcttggcgcaggcgaggatcgcgtccttcggcagcgtctcgccggcctgggcaccgccctgatagcccttgaccatggcggaggccatctcaccgatgagcatggggtcctcgccgaaggtctcgtccacgcgaccccagcgggtgtcgcgcgcgatgcacagcaccggggagaacgtccagtgcacgccggtcgaggagacttcttcggcggtggcacggccggccgcttcgacggccttcgggtcccagctcaacgccatgccgagctgggaggggaagatcgtggcgccgggccagaaggagtagccgtggatgcagtcgtcgccgatgacgagtgggatgccgagacgggtcttggtgttcacggtttcgacggcgcgcggcaggtcctcggggctggtgtgcaggatggagccgacgtgcttgttcacgatgagctcgtcgaggtcgccaccgcgggcgtcgagctgcatcatctggccgaccttctcttcgagggtcatgcgggagagcaggtcggcgatgcgctcggaggcgggcaggtcggggttcttgtagggcagcgtttcgactgtggtttccggtgtggtcgcggtcatggttgtgttcgcctttctgggttccgtgcggtcactcgatgacgaaggtgttgaaggagcgcggggcgagcgtggccttgaagccacgggaggcgtcggccgggtcggcgaactcgaacgggcgttcgtcctccagcgcgttctgggtcacgaccacgatggtgccgtccgggttgcggaaggcgatggccatggagttgaagtggctggtggtgccgagcaccttcgcgccggggcgcacgtacttggagaagtggcgcatcacgtagtattcggggttgtggcgcacctcgtgcgtgtcggcggtgatggtgaacagggagttctggcgcgaccccggccagccgaccaccgaccggggttttcgtaatcctagaccaaacacacccggcacctggcaggccgcggccggtacgacaagggccagaacgcccgccaggacgctccggcccgaatcacggccggcatggaacccggtcagcgctggaacacgtcggggtgcttcggatctccgggaatatcgtcgagcaggccctcgaggccgaggaactcacgccagaagtcgagcggctggccatacgggttggattcgcggccgtgcgcctggatgttcgccttggcttcgaacacgtcttcctcggtgagcccgtcgaagtagctttcgagacggatgcggttggacggcacgtagtacagggacgcgatgatctcggtgagccgttcgacgcgttcgatcggcagcgaatcccagtggcggaactcgatgaagttcttgagacgcacgtcgttgaaatgcgtggagatgatgtggttgatttcgtacgcgttgagctcgcggtccgggtagacctcgccagcgttctcacggaaggcggcgcgatgcagctccttgcggctcagccccgattccaccgcttcgggcgtgtgcgtcaggtcggcgaacatcagcggcgtggacagcacgtcacgcgcgtagtcctcccagccgaaacgctggtcgaacaggccgggggtcacgttggtgcgctggaagtcgaggtagtcccacatgcgctggcgcagcagcggatacgggttgagacggccctcgaagtagggggtgttgcggaagaaccatgcgagaatcggcccgatggcggtgccgacgcgcatcttatcgatcgaatccttctcgtcgacatagtcgatgctcacctgggtggaggcggagcagcgcatcatgcacggaccgaactggccgacgcggccaaggaagtcggtcatcgcgtcatagcggcctttcggattgaccggcacgtcgacgaaactcgacttcggctggtatccgtagttgacgaaacggaagcccagctcctcgaggatcgggtccgcctcacaccggaagtcggcgtacaggccgttgaggtcgcccggctcatgaagcacgccgatggaagcctccacctggccgcccggttcgagcgacaccgcaacgccttcgcgcgcgagtccgaccagatggccgttctcccagtattccttgctttcgtcataatacggagcgagccgtttgaggaacgcttcgatgccgttcggctcgtagtagcttacggccgtgtcgtcggcgtcatgcaccggcagatgctcaatctcgacacctaaaccaccggtgccgcgcttggagcgccccgcctcgaagaacttcagaaggctctcgacatgcttcgggttcggctcggcgagcaggtgcgcatagctgattctgggagtgaccatgaacggtatcgtaggcgagtcgcgcgacgcgcgtcgccgcgcgcccgcgaatcggctatatctttttccgataaccggcacgtcgccggacatccgccatatcacgccgcaacgccgcaccgcgccgtcgcaccacaccgcgccgccacgcccccatcaccgcacgccacgcctccgcaacgccacgccacaccgtacggctttgccgttatgcgcgatgtcggatacactcattgatttgtaaaccttgtttacagaaacgtccggcagagaggccggaccacaccatcaacccaccatcaacccacagcgaacagccggaataaaagaaaaacaacagaaaacaacagaacacggaaaacagcaacaacccatacaaaacaccggcaaccataagcacgtcggaagcacaccggaacgcacaccgaagcgcaccggcgaccgctccggttccacaccgaaaccacgccgaaggccataccggaaacggaccgaggacatatcggacacgcccggcaccccaccggcacgccggtgcgccacaatcgaaaggaaggaaagcggcatgacatcccgtcagggcagacaagccatagccgcgacggccgcaatgggcgtggccgtcgcgctggcgttgccgaccgctgcgttcgcgcagtcagcaacgcaaggaaaggagaccgctacgaccacgtcatcaggcaccacctactacgtgtcgtcggcacacggcgacgacgccaacgcgggcaccagcgaaaacgcgccctggaagtccctgaccaaggtcaacgacatcgcctcggacctcggtccgggcgattcggtgctgctggaatacggctccgaattcaacgaccagtacctgcacatcaaggacaccgccggcaacgccgacgcgccgatcacgatctccgcctacggcgacgccgacgaaggcaagccggtcatcgcgtcgaacggcgtcaaaggcagccagtgggagcaggactaccgtgccaacgtcggcaaccacaagaacaagggcaccgtctcaaccacgctgctactcaaggacgtgtcgtacatcaccgtctccaacctggagatcaccaacgacgacgcggacgtctacgatccgatcgacacgtggaagtggaccgacacccctgattccgacggcacaaaactcgaccgcagcgcctcgcgcatggaccgcaccggcgtggccggcatcgccgagaacggcgcgacgatgagcaacgtgacgctcgacaacctttacatccacgacgtggacggcaacatctacaacaagcacatggccaacggcggcatctacttcatggcccactaccccatggagaacacgagcgccgaaaccgacgtctggctcagggagcacgtctcacgcttcgaccacgtcaccatcagaaacagcaccgtcaaggacgtggatcgttggggcatcgccgtcggctacaccgcctacctcaactacatcgacgcgaactacggcgacggctccatcgacgacgccctcatcgcgaagtacggttccaccaacgtgcgcatcgagaacaactacgtcaagggcgccggcggcgacgccatcaccctgatgtactgcgaccgcccggtcatcgaacacaatgtgggcgacagcgtctcgaagcacatcaacacgcaggactacacgcagcccggctcctacggcggacgcgtggcggccggcatctggccgtggcgttgcaaggatccagtgttccagtacaacgagatgtacaacaacctcaacgccgagcacggcaacggcgacggccaggcgtgggacgccgactacggcgacggcacgctgtaccagtacaactactcgtacggcaacagcttcgcctcgctgatgatctgcaactggtacgcggttaacaccacgttccgatacaatatctcgcagaacgaccgtcagggcgtgttcgacctgccgtcgaacggccccggcaaccacatctacaacaacaccgtctacgtggacgccgacagccaggtgctgactaagcgttccaactcgcagtccctgttcgagaacaacatcttcatcaacgcgaccaacacgaagaagacggagacctggaaccgcggcagccagaacggcggccagacgtacgacaacaacatgtacgtcaactacgcgaacaagcccacctccgacgccaacgccatcgaggccgacgacgtgtccgcagtgcttgcgggcgccggttcggctccgacatccgccctcaagagcggcgccgagcatgcgcgcaccggcgagaaagccgcgttcgacggctaccgtccggtcgcgggctcgaaggcgatcaacgccggcaaggtcgtctccgacctcaacgactacgcggtggagaacgacttcctcggcaacgcagtcaagggcaggcccgatctgggcgccgtggaaagcgacgtggtgtccgtcacgatggcctcctccaagtacgagaccggaaccgaaaccgattccgggaccggtgacaagaccaaggtcatccacgtgaccttcaccgacaagaacccggtgaccgtcaaggaactgctctccaacgtgtccgccgacaagggcgtggacaaggccgtgtaccgagtcgccgacgccaagtccggcaagtccgccgacgccaggtccgccgagtccgaaccgaacatgctcgaccgcctgctctccctgctcccaggctccgaccggaacgccaaggacgacgagacgaagctcgccgactccgaaccggtccgcgatggcgacatcctgcgcttctccgccgaaggcacggacgagaccgacgagtacacgatccgccagcgcatcacgtgggattgggtcgcggactacgagcaaggcgtcgccgacttcgactggaaggcgcagcgccgcacgtccgccggcggcgagtggaccaccatctccgcatacgacggctcgtggccgaacaccgtgtacgaccagtactacggtgtcggcgtcaacggcaccctcgccgaactctccggcgaccgcaagcagacgcacggcctgctgatcgacaagcccggcgacggcctgcccacggccatggcgtggaaggcgccggagtccggcaccgtcatgctgtcgctcaagacgttcgccgacaagatcgctgaaccgtacctgcgtcagaacgcggacaacgccggcaagaaggtcacattgtcgctgatgcgcaacgacgagacgctctgttcggccgacgacctgtccgtctatcagaagtcctccgaacagttcgcgcagtgcctcgccgagcacggttcgatcgacgtgcaggaaggcgactggatccgcatcgtcgccgacgccgagaccggagtcaaggcgccgtcgctgcacatcagcccggtcatcacatatgaggacaaggcgcccgccgcgccgaagcagaacgtgcgctacgacgtctcgtacgccgcgacggacgccgtcgtcggcacgcagtcggccgtcgccgccgcgttcaccgcggacggcggcgaggccgacgcgccggacggcgtcgcgttcgccttcaaggacggcggcgatgagggcgaggcctcgcccgtcatcgacgcgtccaccggcgccgtcaccttcacgcccgccgccggacagtacggcgcgaccgtcacccgcaccgtcgtcgtcacgtacgcggacggttcgagcgacgagacgaccgtcacgttccgtgtcgcgcaatcgcacgcgcagcgtctcaacgtgctgtacccgaccgtgcgcggcgacgccggcacggacctgaagcgcacgccgaagttcacgctgaaggcggacggcgcggccgcgtctgtgccggaaggcacgacgttcgcgctcggcgcgaacgcgccggccggcgcgagtgtcgacatggcgaacggcacggtcacgctgaacagcagggtcggcggcaccgtcaccgtgcccgtcacggtgacgttcgccgacgacggcgccagcgtctcctccaccgcccgcttcgaggtgaccgcgcccgccgcgctcggctcgtccgagttggagaccgcgactgtcgacggtgtgaacgtcgtctacgcgccgttctccgccgacagtccgatgaccgtcgcgcagctgctcgccaaggtgacggccgaaccgtccggcgccgataagggcgtgtaccgtgacggcgtgcggttggaggccggcgcagaactcgccgagaacgacgtgctccgcttctccgcgaaaggttccaccgtgtccgacgactacgtggtgaagtcgaagaccacgtgggattgggtgaacgacttccaggtgcgcgtgcagggtccgatctggtacgggcagcgtcagaccgaggccgacggcgtgtggtcggatatcgccgacttcgacgcgacgtatccgaactggatgtacgagacctactacggtccgggcgtggactacgcgaaccacagcctgcccaccgaccgctccgccatccatggcctgatcagcgattcgcccgcgtccgctggtggctccgccatggcgtggaaggcgccgaaggccggcacggtgaaggtgtccatccgcgaggacgagccgtacctgcgccaggacggcagcaacggcaaggcgttgacgcttcgtctcatgcacgacgacaaggtggtgtgcttcgccgacctgaccgtctccaagcagcgttccgaggagttcgccaactgcgtcgccgacaagggcgagatcgcggtcgaggcgggcgattggatccgcgtcaccgcgacgtccgcgtccggcatgaacaagccgtccgcgcacatctccccggtcatcgcctacatggccgcctccacgccgggccccgaacccgttccggtggacaagtccacgctgaaggccacggtcgaggaggctctgggattggccgagtcggactacacggatgagtcgtgggccgcgctcgtcgccgcgcgcgacgccgcgcagaccgtgctggacgacgatgccgccaccgccgaacaggtcgagaccgcgcagaacgcactgcgtgacgccatcgacggattggagaagaagccggtcgatccggacccgaacccgaaaccggatccgaaccccgatcccgatccgacgcccgacccggaccccgaccccggccccgacaccaagccgggtgacggttccggcaacggttccggcacgggcaacggttccggcacgggcaacggttccggcacgggcaacggttccggttccggcaacggttccaccggttccggcagcgacggcgcgaccaccggcggcaagctgaccgccaccggcgccgacgtggccggcgcggccgcgatggtcgcgctgaccgcggccgccggcatcggactggccgccgcggcccgtcgccgcaggtgaccgatgccacgtaggcaccggttcgccgccgccatcgccgcagtcgcggtggcggcggtcctgctcgtcacattgaccgtcgccgtcgtcacgcacggcgacggcgccttcgcgcccgcaggcacgcctgcgggcgcgggcgcatccgccggcatcggctccgataccggctccaatgcaagcgaggattccgacatgttccccaccatcgtcttcggcgacaccgtcatcgaacgcaaggagtacgtcgcggcgctcaaggcgcaacacggcgcggcgcggctgtactttcggcagacgtacggcgtcgacccggccgaggacggctgggataaggcgcacgacggcgaggtcccgtgccgttggctcgcgagccgtgccatcgacgaactgcgacgtcggcacgccgcgtacctcatcggcgtggatctcgggcaggtggccgacgactcctatgcgagcatcgtcgcgcgcatggaggccgtgaacagcggcaacgcggaactgaaatcggacggcggcatcgtctacggccgtaccggcttcgacatcgacagctacctgagctacgaactgtccgcgttgaagaacgcctatacgggcgacgagtcgaaccccggcatgagcctgtccgacgacgaggtgcgacgctactacgacgagcacgactggacaaaggacggcgtcgacgggaaggctccgctggacgaggtgcgcggcaacgtgaaggcgcagatgcggtcggaacgttacgacgagctcgtgagccagcgcgccgaagcgatcgacgtgaccgacctgccatgggacgcgctgtaccggttcacggcaggcaggctcgggtaggacgggtgtgaccggtgccggccgaaaagcaccagaacgaataaggcgggtgtcccgttccatacggaatgggacacccgccttgtcgtaggccgcagaccggtttgcccggtctgcgccggtctggtgccgaccgggcgtcggttggacgtcggtttgaggtcagtcggcggcagtgaagccctgcggctcgtcgccgtcggcgaacttcgccttgtgcgccttcttcgcggccgcgatcatcagcttgatgcggttgagctggttcgcctcggaggcgcccggatcgtagtcgatggacacgatgttggcctccgggtgcaggcggcggatcttgccgaacatgccgcggccggtcacatggttcggcaggcaggcgaacggctgcgcgcagatcacgttcgggcatccctgttcgataagctcgaggatctcggcggtgagcagccagccttcgccggcctgcacgccgatcgacgtgacctcggcagccttctcgacgagttcgggcatcggatcgtcttgcttgaacttgccgtgagaggtggcgatggccgccttgatcggcgcgttgtagcggtcgaggctccaacgcatgagcgcgtacaacgtcttgttgccgccggtgccgagatacttctcgttccagtcggtgatgtacgggcgcgtggtcatgaactccatgatgccgggcaccacggcctcgcaatcctgcgattcgatgacgtcgacgacatggttgttcgcatccggctggtatttgacgaggatctcgccgaccacgccgacgcgcaccttgcgcggcacgtccttcaacggcagagcgtcgaagctcttcacgatctctcgggcgagcacggggtacggcaggtagcggcgcttgagccacggggtcttcgcggccgtcttcgagaagccgtggtgttcgagcgcctcgcgcacgatcacgtcccactgctcgtacaggcggttcgccgcgcccttctccacctcgtacgggcgcacgcggtacaggcacttcatgagcaggtcgccgaggatcagcgccttgacggtgcggtgcagcagcgcgggcgtcaccttgaagcccggattgtcctccaggccctgcgtggagatcgcgatgaccgggatctgcgggtaacccgcgtcgatcagggccttgcggatcaggccgaagtagttggtggctcggcacatgccgccggtctgcgtaatcgcgagacacaccttgtctggatcgtatttgccttcgagaatcgcgtcgatgagctgtccgatgaccatgatggccggatagcaggcgtcgttgttcacgtatttgaggccagtctccacgtcttcgcgcgaggcgtgcttgaggatgtcgaacttgtagccgccggagcggatcaccgattcgacgagggagaagtggatcgggctcatctgcggggcgacgatcgtgtagtccttcttcatgtccttgacgaacttctcacggtgcgcgtaacgggacatggtcgcgttgttgtggccggacttcgacttcgcggacttcgacttggcgttcgcggcatcgttcgtggtgccgtcgccgagcgcggcgagacgcacatcggcgatgtcgcgcttcgcggcgcgcttggacgcgtcgcgcatcgccttggtgagcttcgggttcgcggccatcgtcgcgtcgagcaggacctgacggcccggcgtgggcgccttggagccggtcttgcggaatccggtggacttcggcgcgttcgcgggggcggcggcgtcgctgccggcatcggccgcgtccacgggcctgtcggcggccttaaccttcgcttcggcggcggcgacggcggcctgcgcttcggcgagcgcggcctgcgcggtggcgagatcggattcggcctgctcctgcgccttgcgggcggcggcctgcgcggcggcgtgagccgcgttgcgcggggcgtcggactcggcggaaccggactcgtcggacgtggcgagcgcggccttggccatgcgcgccttgttcgcctcgcgttcctcgacggcggccttgagcgagcgcaggcggatcttcgccgcgccgaggttggagacctcgtcgatcttgagcagcgtgtacacgtcggccttgtcggcgaggatctcggccacctggtcggtggtgatggcgtcgaggccgcagccgaacgagttgagctgcacgagttcgaggcccggataggaggcgacgaagtgcgcggccgcgtagaggcgcgaatggtaggcccactggttggtgacgcgcaacggcatgcggttgacggtgaccttgcggtcgtcgacgtggcggaatccgttcgcgttcttcttgcgcgggtcctcttcgccttcggacaggaagtcggtcaggtcgagcttctcccccggctgcagttcgcagatcgaatcctcggagaggacgaccatgccgagcgcgcagatggtttcggggatgccgtggttgatttccgggtcgatgtggtaggggcgtccggcaagcacgatgccgcggcagtcgtgctccttcatgtaggcgagggctttgaggccttcctgctggacgtcgtgtttgaagaccttgtcttcggcgtaggcggccttgacagcagtttcggcctcttcgcggctgacgctcgcccatgcgaactcctcgacgatacggtcgaccatgagctcgtggttggcgaggttgaagtacgggtgcatgtagcgcacgtcggggtcacgcagttcgggcatgttcgcgccgacgacgagcggatagttggcgacgaccgggcagttgtagtggttgtccgtgttgggcacgaggttgtcctcgtaactgacgcacgggtagaagatcgtcttcatgcccttgttgagaagccatttgatgtggccgtgcacgagcttggccgggtagcagatgttctcggaggcgatcgattcgatgccggtttcgaacagttcgtggctggaacggccggagatcatcaccttgaagcccagcgaggtgagcagcgtgaaccagaacgggtagttctcgtacatgttgagggcgcgcgggatgccgatttcgcctcgggtggcgttcttgtcggtgaggcggcggtaggcgaagcaacgcttgtacttgtagtcgtacaggttcggacggtcggagcgtttcttcttggcgtcgccgccgcgttcgcagcggttgccggtcacgaagcgcgagccgtcggagaacgtggtgatggtgagcttgcagtggttctggcacagcttgcacacgtcgcgttcggtggtcatcgacatttcgttgagggcttcgccggtgaggattgacgagacggtgtggcgcacgccgtcgacgacgatttcgccggcgtgcgcggcggcgttcggctcgtcgccggcggcggactcctcagccgccgccgcgtcgacggaacgcccgtccgcgccgacgtgcgcgttgtcgtcgtccgcgatgtcctcgtagtgcatgcgggcggtgagggccgcgccgaacgcgcccatgaggccggcgatgttcggtcgggtgacttcgcgttcggtgagcagttcgaacgcgcgcagcacggcgtcgttgaggaacgtaccgccctggaccaccacagtgtcgccgagttcgccggaatcgcgcagcttgatgaccttgtacagggcgttgcgcaccacggagtagcacaggccggcagcgatgtcctcgatggaggcgccttccttctgcgcctgcttgaccgaggagttcatgaacacggtgcaacgcgaaccgaggtccaccggatgggtggaagccagagccttttgcgtgaattcctgaatcgtcaggcccatggacatggcgaaggtctgcaggaacgaaccacagccggacgagcaggcctcgttgacggcgattgaatcgataacgccatcggtgatggccaagtacttcatatcctggccgccgatgtcgatgacggcggtgacgccggggctgaccatttcggcgccacgatagtgggccatggtctccaccacgccctcgtccaagtgcaggccggtggtgatgaggccttcgccgtatccggtggcgcaggagcgtgcgatccacgcgccttcgggcagctcagactgaatcttcttgacgatgttgatggcggcggtcagcgggctgccttcgttgttggcgtagctggaccagacgatttcacggtcgtcgttgacgagcgtggccttgatggtggtggaaccagcgtcgatgcccaggaagtgcgggccgtgcgcgccttcaagggtgccgatgtggatgtgttccttgtggtggcgcttgttgaagtcctcgcgatcggcctcggtggggaacagcggcggcatggtgggcgtgttggaaggcaggttcttcagctcgtccagacgcttcaggatatcgtcgcacgtgtgggcctcgaaataattgccctgatcgtcggagtctacgtcggcctgcaatgccgaaccgtaggccacatacaggtgggcgtcggtcggcacgatgaattcgtcgaccttgccctcaagcgcgcgctggaatgcggcgcgcagttcagacatgaagaacaatggaccgccgaggaagatgacggtgccgtgaatcgggcgtccggaagccaggccggcgatggtctgcgtggccactgcggtaaagatggaggcggccaaatcgggcttggccgcaccatcgttgatgagcggctgcaaatcggttttggcgaacacaccacaacgcgaggcgatcggatacaggttctcgtagctcttggccatctcgttaaggcctgcggcgtcagtgtcaagcagcgtggacatctggtcaatgaacgcgccggtaccacctgcgcacgaaccgttcatgcgttgttcgggcgtgggtttcaggtaggtgattttggcgtcctcgccgccgagctcgatgatgacatcggcctgcgggtattccttgtcgattgcctcggtttcggcgatgacctcctgaatgaaaggcacatgcagattgtcagcaagcgccagaccgccggaaccggtgatagacaggcgaatcggttcgtcgccgcgtccgaggtccacaagcttcttgtggatgtcgaccaacaggccggccacggtggcacgcacgttggcgtggtggcgtcggtaatcggagaagagggtgtctcccagggaatcggactgatcaagcaccacggccttgacggtggtggaaccgatgtccaatcccacacgcaggggcttcgggtgtgaagcgggctttaggctcgcgtcagtggcgatgtcaaccatgtgttcctcttaattccgacttccgggagtgcacgctttgaggcatcatgaaccgtttcgggacggctggcagataccctgcggacggcttcgcccggctacttcttatggaatattagtccgaccacctgcccaacatggcacgaggcgaggcgatttcgctcacgggaaggccttttcccaacagttccaacgatattgctgagtgcggcattccagaactgctactacgaggcctgttggccttcgccggcttcgcggtctttcaaatagatttcggggatatctcgttcttgatcgtggagcttggcccagatgaccggttcgccggcttccagagacttgggcacatcgaggatgcgctggtttctggagccgcggaattgcagcagcgagtccttctggtctctgaggtagcggccgtcgacgagaatgtcgatgagatgtagcaattcaagcttgtctggggtttctccggggcgcatgagttcttcccatgtgtagccggtccacgaccagatatctttggtatgaccgaattcctggcggatacgttgtgcgagcggcaccagcacgggagtgttgaggaatggctcgccgccaaggaacgtaatgccttgcacccatggggctttcagatcttcgatgattttgtcttcaagtttttgcgtgtattcgtggccggcttggaaatcccagatggaggcgttgaagcagtcgacgcagtggaaggggcaaccggagacgtaaagggagttgcgcacgccttctccgtcggtgacaatgaaggttttgtagtcggcgatcatccgcttggacatgcgccggccatcccattgaccggctttcggatcgttggcaagaccgttggagggtacggaggggccacgcccggtctcgccggccgcaaagtcatggcgcttgggttcgggcttggtcgtatgcagctccggcatgattccctccttacggaaagcattagctcccgctggcgggagctgtccgtcatcagacggactgagggtggtcaacaccataaaggatgaccgccctcagtctcgcttacgctctacagctcccgtcagcgggagcaagtataaaccctacttggtctcttcgaaccactcgcgagtggttccgtcatccagcgtcacacgaccggtttcgccgctcatgtgcttgactcggtgggcaatttcctcgtgacggccgtgcaccatcgggcgctggaccgggctgccgagatagccgcaggtgcgcttggtgacgttgcacttgtccgggttggagttaccgcactccgggcacttgaagccttcctcggtcggctcgaagtcgccctggaagccgcacacgaagcagtggtcgatcggggtgttggtacccaggtagccgatgccgatgttgtaggcgtaatcccacacggcttcgagcgccttcgggttgtcctgcaggcacgggtactcgcagtagttgatgaagccgccggaagcgtagtacgggaagtccttctcgtagctgagcttctccatcggagtgggctgcaaccacaccgggtagtggaaggagttggtgtagaagtcgtgatcagtcacgccttcgatacggccgaacttttcacggtccatgcggttgaagcggtcggtcagggattcagccggagtggagtacacggaatagtggtaaccctccgctttgctccactgcttgcacagctcgttcatgcgcttgacgatggacagcgcgaactccttgccttccggatcccagccgtggtcgcgaatccagttcttgccatagaagaccgcagtggtctcggcaaggccgatgtagccgagcgacacggtggcacgctcgttcttgaacagctggtccacgttgtcgttggcaccaagacgaccaaacgcaccaaagcggaacagggtcggggcgttgaccggggtggcttccttgcagcgcatgatgcggaactggagggcctgatgggcgacttccatacgctcgtcgaacagcttccagaagcgagccttgtcaccgtgggattcgatggcgatacgcggcacgttgacggtgaccacgccgaggttcatacggccgtcttcttcatccttgccggtctccgggttgatccaaccctgcaggaaggagcggcaacccatcggagccttgaaggagcctgtgatcttgacgatgttctcgtagaacaccacatccgggtacatgcgcttggtggcggactcgagggcaagctgcttcagatcgtagttcgggtcacccgggtcggcgttcacgccgtgcttcacagtaaagacgagcttcgggaagatggcggtgtggtgttccttgccgaggccgcgaatacggttcagcaggattgcgcgctgcacttcacgagagaaccagtcggtgccgagaccaaagccgacagtcacgaacggggtctggccgttggacacacggttggagttgatctggtattccatggtctgcatggcatcatagatggccttgcgggtacgaatcttggcgaggatttcacgctcttgctcaagttcgtcaacgtcggtgtggaacggggtgtccatcggcagcggttcacgggaaccgaaatgcagcttggcgggctcgttcttcttggcgctctcgacctgacgacgggcgaattcaaccggcatgccgtcggggatggtctcacgagcttcctcaaggaacttctcgtaatccttcttggcatactgggcaagatgctcgtcggcacggttggcggtctggccaccatactggctggaggccacgtccttcatgatctgggtaatctgggtggccgcaatggcgatggacttcggggaagccatcggagcgttgccaagagtgaagccattggccaacatgtcccagaagttcggcaaggagcagttggactgggcagtgaacggcgaatagtcggcatcgtggaagtgaatgtcgcccttcatgtgggcgttggacaccgccggcggcagcatgttgaacgcggcggccttggacacggcaccggccagcagatcacgctgggtggagtagacgttggaatccttgttcgcgttctcgtgaatcagggtcgggtcatgattaatgaagcgagcaacggcctcgttgacatcagtggccttggcacgctgaatgtctttgtcgagacggtaattggtgtaggcgcgagccacatcgtacaggtgggcgtcaatgagggcgtgctccacgagattctggatgtcctcgattttggcggggccggtgtaacgccccttgatttcgccttcgacttggttggcgaaaccacggatcatggcatcttcttcggggccgacttccttgttcaggtcgccgaaagcagacttgaccgcagagatgatgttgatggggtcgaagtcgaccacacgaccatcacgcttctcaacgagcacggtggaggccttggcggccaccttggtctcgttatcggtgacggtttcctccagcacctgtgcgcccatcgggcacccctttcctataaggcgaacactctcctgagttccgcattttggccgcactcgacgtgggccacacgaaattacattgatatcgttttcttgaacctctagaagaatacggcatccccacccctatatctagtgctcaacagtggtgtgtcgaactatttatagggtttttcggctatttttcgccaaaactacaagtgtgtgattagcgtaactgttttctgctcgcgtgtcgcacagcgagctcactgacgactctcaatcgtcagtgcaacgcatatctcactcctcttcatagcacccgtttcttcgccataatgactcctttcttctgatgcaccagaccatctccatcatcggctgatacatcgcttcgtacggttcttgcattcatcatcacaccgttttcaggcgacggtaaatttttaccgtcatcaaccaacgcacttatagtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcggccagccagttcgttcagggcgaccgcgtggtgattcacggcaaaccgaacctgtggatgaagcgcacttcgctgtcgttgcgcggggacacgattctcaaggtcggagccggtggcagtctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtgacacgccatacgcagccacgcatatataccgtatatataaggagaacatcatgaccgaaaacgccacatccaccgacatgaacacccccgccacgtccctgacggacaaggaacgcgagctcatcgcccagatgccatatgaggaggcgcgcgacaagctgattcaggctgtccaggcactggaaaccggcggcctcaatcttgaccagtcgatgcgtcaatgggagatcggcgaggccttggctaagcgcgcccagggtctgctcaacgacgtccgtgccaagctcgaccaagcacaagccgagcaagccgccaacgaagccaccgcaggcacgcagtccaacctcgactgagttgcctcccggtgcggcatcccgcggctcgcacctgagtccggactggactgagttctgcttcccggcatacgatagtggtgattaggccacattggcagcagtttatagaagggaaatcccatgtcaacgttgattcttgtattccatccgcatcttaaggacggctcgcgcgtgaacgcccgcctgctcgccgaactcaccgcacagggcgaggacgacatcatcgtgcgcgacgaatacgccgaatacccgaacttctccgtcaacgccgacacagagcacgagctgctggaggctgccgaccgcgtaatccttcagttcccgttctactggtactcctcccccgcgctactcaaggaatgggaagacgaggtcatcaccgccggctgggcctacgccggagcccatgcgttgaagggcaaggagctcaaactggtggtcaccactggttccgacgccgccaagtaccgcaaggacggcgagtacagccacaccatggaggagctgctaagcccgtttgaggtcgtggcgtacaaggtcggcatgaactatgctgagccgttcctggtgcagggcaccgccaccatcggcgatgcggagctggatcaggccgccgccgattatgtttcggcgattttggactgaataagctgaggccgggtgcaagtcgcacccggccttgttgtttcgcgggctagccgcggtctctcccagtcagcctgcggctgacagttccctcgtcagagagagcttattttttggatcagagggagttgatagctacttcttcaacggcacgtagatcacgtcgtcaatgagctcgcgatagtgctcaacgatttgcgcgcgacgggtcttcaggctcggggtcagcatgccgttggcctcggtgaattcgtctggcagaatctcgaacttacgaatcgactcggcgcgggaaacgccctcgttggcggcgttcaccgcacgctccacctcagcgtgaacgatggcgttcttggccagcgaggccagatcgggttccggtttggcgccctgggattccagccaattgttggcatccgccagatccagcgtgaccagagcggccacgaacggcttcttatcaccaataaccaagcactggttgaccacaggcgaggtcatcacggaagcctcaagcagacccggcgacacattcttgccaccagcggtgatgatgaggtctttcttacggccggtgatggagatgaagccatcttcggagatatcgcccagatcgccggtgtgcagccagccatcagtgatctgctgggcagtgaccccagggttgttgtggtagcccttgcacaccagcggtcctttgaccaccagctcgccgtcctcggcaatgccggcggtgataccgcacatcggcatgccgatggtgccgatgcggttgtcctctggcaagctcacacacaccgggccgcaggtttcggtcatgccgtagccttccagcaccggcatgccgatgccgttgaagaagtgggaaagctcagagtccatcggggcaccgccggtaatggcgaagtcggcgttcggaccgaaaatcgtgcgaatcttcttgtacaccacctgctcatagaaggcgtgggcgatacgtccggcaatcggcagctgttcgcccttctgctcggccttggaccattcgcgcgcgttttcggcggcgcgcatgaacatcttgccagcgaatccggtgccggcgcgctgggaggcggcgttgtagaccttctcgtacacacgcggcacggcgagcagcagcgtgggaccgaaggtctcgaagtccttgaccatcgtcttcatattggagctcaaggccagcgaaatcgtgccgccaaaactgaagaattccaggaatcgggcgaacacatggctcaggggcaggaacagcagcagacggcggttgggccatgcgccggcacgaggcatgtactgcagcgcggaaagcaccaggaaggcgaagttgcggtgggtcagttccacgcccttcggggtgcctgtagagccggatgtgtagacgatggtggcgcggtcgtcgccgtgggaggcttccttgtattcccagaattcggcgtcggtgacgctttcgccgtaggtcttgatggcgttcagaccgccggcctcgattacgaacacgttgcgcagggtgggcacctcatcgcgcacggattcgatcttgtcacgctgcccgtcatcttcggcgatggcgagcgtgactttggaatcgttgaaaatccagctgacctggctggcggagttggtctcgtacaccggcacggtgagcgcgccgatggacatgatcgccatatccagcgcggtccattcccagcgggtgcgcgagacgatggcgactgaatcgcccttgttgacaccaagtccgaccaggcccttggccaagtcgatgaccatgtcacggaatacttgggcgctgtacgggtgccaagtgccatcatcgcccttgtattcgatcatggcaccttcgggatcgcgcttggcgcggttatcgagcagatcgaacaggttgatgtcgctgtcaatcggctccttgacgggattggtgaactgcttgacgatacgagtatcgtttatggccttatcagcgatgttttcagtcatactccccatgcaactccacggatgctacaaaacacgcgcgaaacaacggattgtccagaccaaatggccccggcaatccgttatttcgggcaaaccaggtaaatctgtcgcaccgtacattcagcagattactcggcggagttattggcctttttcagctcgtcgcgaatctcctgcagcgtggcgagagtctgctcttcaacgctaggcccctgttcttcagcgtcagcctcatcctgggcagcagtgagatcacgaagcttattaatcggcaaaatcacgcagaaatacaccgccacgccaacaagcaggaagttaatcagcgcgttaagaatcgcaccaaatgaaacagtcgagttgttgaacgtgatggtcagcagtccggaaagatccggtacgccgccaatcatgccgattaatggactgatgagattgtcgacgatggaattgaccacagcggtaacggcagagcccatcaccacacctaccgccatatcaatcatcgatccgcgcgacaggaatttcttaaagccattcaacggacctttatcggtcaaagcaacaactttgcgagcggttcctcccgtggccttggcaaagtcggtggcaatattcatgggattgtggttactcataacggcactccttacgaaattcagacacttcacttgtatccgactggttttcccacgaccccattatgccgcttgttggaatatccctataccactgcggcgttcccgtacatgactatgtacgagaacgccgccaaccctgcttgcagagaacctgttagagctgtttagaactggatgtaatcgacttccgtatgctcgccggtttccaagtatttcgccacatcatcaggaccgacgaacaccagttcgaccgcttgcgcaatcatcagattgacacgatccattggcgtaaggttttcgaaatagccgtacaccgggattcccagcgcatgcgcatatccgatttcgaacatcgtgcccgggtcctcgtccataagattggcgaccacggctttagcagcattaatgccatggatatcgtccgcaaagcatccttcagggcctacttcttcgatctggctgacaaaccgcggcttgaacagtaccttgccatggtcttccaatatcttttccaaacgttccatacttgccgtttgttcaggatcaaagaacggaccggccacatagaagtcatactgtttgtcttcactcatggtctctagtcatagcgcagcaacgtcgaacgtcagccgttattttcactgtatggacaaggggtcgtattgtgaacattgctacgggataaccgtcaacgactacgtacgttgcccacgattggcgcatgccgccgctcttgcgccgtccgcactgccagcccgtcagccgcgattgacgatttgcatggcgcggccatcgtccatcaggtggaagccatgcttctggtagaacggtgcgtttttgctttcctcaggcatgacttccagcaagaagtagtcgcgatacttagccttgaccagttcaacgagatggctgccgatatgctgcccgtgatatgccggatctaccagcacccaatgcatataggccaccatttcggtatcgtcgagcacgcgaaccaagccgaccaaatggccgccatcccatgcgctgatcaccgtatccgaatgctgcaatgccttgaacaaccgttccggccactgcgccgattcccaacctaccgacttgaacagcgcctcaacctgctcaacagtaaaccgcttctcttccgtgtattcgatagccatggaccctcacgacaaccgtgaagccccacatgtctttgcatagtttcacacgacgggatgatggatagtggaacctatacgtttacacatgcctaatgcccatggctcatcaccgatgaatagaggctgagataccgtcatgtttccgaagccaagtgcccgagatcggattcgaaccgacgacacccgctttaggagagcggtgctctatccactgagctactcgggcaacgacgtttcattgtacacggccacacgcccagtcgcatcatgttcgcgtggcagcttgcgcaagccatccggcaacctgagcaagccacatggaggaacccgacatcaggtcatggcccggtctttcgtgccagtttggtgcgaactgctcttgcgcacggcgaaaagacactgaaagacaagccgtacacggtacagtggcaaatcgcacgaaaagcaaagtaacagtaaacaagccggaggaaagggcagcatggcaaaggcacggagtactaccacaggcgcaagcgtacgagctcgcgccgctgccaagccacgctctgccagagccacggcacgcccagtatccaagtctgccgtgaagccacacaaacggcatcgtctgcttggttttctcgccacgatgttcgcgcttcttgcccttgccggcgctgccgcccgcgcgctgcctgccgatttacaggaactgccatttgcgccgattgtggtatcggcaacgccatggttcacgttgcttggcttgattgccctgctgttggccatcgtgtcgcggcgtatccttgccgcactaatcgccatcgccgcaatcgcatgcaatggctattggcaatatccgttcttctactcgaccgatccactcccccaagccgcgcagaacgccgtggccgcagcctcccccaacaccagcgatgcctacgcgcgcgtcatgaccttcaatgtgtataaggggcaggccgacccgcaagccatcgtcgagctggttcgcgatcagcgcgtcgaagtgcttgctttgcaggagaccaccgaggatttcgtcaaaaaactcaatgaggctggtattgagcattatctgccgtatgcgcaggtctcatcgtctgacggcgtattcggtaacggcctctggtcggccacgccacttgccgatccgaccgacgatgacgtgaattccagcgcctcattcatgcccggcggcacggtggatatgggtggccagcagattcgattcgtatccgtgcacaccaccgctcccgtacccggctactggcggcagtggaagcgatcgctggatgagttgggtctgatgcgcgagcatacggatacacggtatattttcatgggcgatttcaacgccacttacgatcacacgccattccgtgattttcttggcgaccggttcgtggatgccgcacgtgaatccggacatgggtttacgttctcatggcccacgaaccgtgcggctgtgccaatgttcgccggtattgaccacgtggtgcttgatcagggcatgaaggccggacaatgcaaggtggtcaaagtcgagggctctgatcatgcggcattgttggctaccgtggcggttgggtgattcccctcaataggactagaaaccgaggcgggtgcggccgaattggtcgagccagcgcaaaatcgcgccttcacgcagcgcccacgggcagatctcgacttcctgaatattcagggccttcatgatctcgtcggccaccacgccgccgcccacaatctgcatcgtgcgttcaggcgtgatgccgggcaaagccacgcgctgctcaggcgcgatcgccgccaaacgaggaatccagtcttccaactgctcacgagtcataatccatgaatcttcgcggcccggcgcacgcatcaccgcaccgcacaggcgagccagcgagcggaaggtcttggaggtgccaactgcatgattcgggtgcttggattgcgggaaaaccttgaccatcggctccagaatcttgcgcacgttcttacgcacgtcttccaactcgtcgggcgtggccatgccggaaggcagaaattcagtggtgacgcggcccgcgccagccggggcggaaagcgctacggtcggctcttcgtcggagcccatcgccacttcgagcgaaccgccgccgatgtccagcaccagcagtcggccggcatcccaaccataccaacggcgggcggccaggaaggtcaggcgagcctcatccgtgccagacagcacagtgacgccctgaccaatcagttcctcgatcttgtgaatcactttgttgccgttcggcgcctcgcgcagggcggaggtggccataaccagcagctgggtgatttcgtattcctcggccagccgcatgcactgggacacggcttccagaatcgcctcgatgccggacttcttgattgagccgtcgtcctttaaatacttcatcaggcgcactgtggatttggtgctggcctcggggtcagggcgagcgccgggggcggcgtcgacgataagcatgtggatagtgttcgaaccgatatcaagcacaccaagtcgcgtggtatgcgaacgcagattgaccatgattcctattcctgaccttacctaacccgtgatggccgaacaacgggccgaccatcgcaatcagccagccgtgcgccaccatggcgagtcgttcggccggcaaccaacaccgtgaggccagccgaacatcacacaaactcgactactgtacaacaatcacaccggctgccgcgccgttcacagcgattcgacgaacgttccgagacgttccagcccctcggtcagggcctcacgtgaggcggcatagctcaggcgcacatgcgtatccgccgtggccgcgccgaagtcgcggccaggagtcagagccacatgggcttcatccagcgcgcgttcgcagaacgtccaggcatccagaccagtgcgggagatgtcgaagtaggcgtagaacgcgccattcggctccacctcaaccggcaaaccgatgcgcttgagcccgtcaatcacaatgcggcgacgggccagcaattcctgacgacgagcttcgcattccgccaagctttccggcgtgaagcaggcgagcgccgcatgttgcgtgggcgtgtgggcgcacaggtagtagttggtggccagatcgtcaaccgcttccagcacagtgggctcgtccggcagaatcgcccagccgaggcgccagccggtcatgccgaagaacttggagaagctgttgcatacgatggcatcggggtcgcaggccagcacggatttgacttcggtaccgtccggctcccggtcagccaagtcgaggtaggtttcgtccacgatgcgccatgcgccgcggctggcggccaacttgcacacctcgtccaatacgttgaagtcgatggtggtgccggtggggttggacggcgacgtgatcattacggccttggtcttgctcgtccagtactggctgcacaggtcggcggtcaggtggaagcgggtggcggccgaggtcggcacatcgatgacccggccttcaaacgaccgcacaagttcgcggttgcatgggtaggaggggtcggccacaatcacatcgtcaccggggtccacggtcagcgcggtggccaacagcagagcggccgaaccgccggcggtcacgcagatacgcttggggtcgatgccaaggtcatgacgctcgcggtagaagtcggcgatggcctgacgcagttcaggtaggcccatggcggcggtgtacggcagggcccggccgtcgtactgttcgcgcatggcgtcgcgtacggcgggcggcgcgccgaaatcgggctcgccaaggcttaatttgatgacgctggtaccttgggcgatcatcttgtctgcttgttcgccgaataccatggcacggaagggattggcctcacgcgctcggcgggacatgactggagacgcggccggagattggggctgctgcgctgcttcgttttccatatttcggttctatccgcctcacgggacaaggtttcttcttctataatcactgtaggtcgattgagtgcaccaacccgcattcaaggaggaataatgagtcgattcaatggcaagcgcgccgagttcgaggccagcggcgaaaaaatcaacgtcgcgattctgggtgcgggccgcatagctcacaccatggccggcaccctgacccagatggctgaagattcactgtattcctcatggattcacccgtatgcggtagcggcccgtgatattacgcgcgcgcaggcttttgccgaccaatggcattttgacaaggcttatggatcgtatgaggagttggtggcggacccggatgtggatctggtgtatatcgccaccccgcacagtctgcacgccgaacaggcgatcctgtgtatgaaagccggcaagaacgtgctggtggagaagtcgttcaccgcgaacgccggacaggcacgtgaggcgctggccgtggccgaggaaaccggcatgctgtgcacggaggccatctggacgcgctacatgcccagccgcaagctcatcaacgaagttatcgagtccggcgagatcggcgaggtgaaagcggcgagcgccaacctgtgctatccggtgtccggcaaggcacgtatgaccgatccggcctgtgccggtggcgcgctgctcgatgtgggcgtgtatccgctgaacttcctggatatggcgatcggtgccgaccatggccgcacgctggatcatttcgatacgtcgatggtgcccgccgaaaccggtgtggatgcgcagaattccaccacgttgtattacagcgacggcacgatggccgtgtccaccagttcgatgctggtttcctccgaccgcggcggctatgtgtggggcaccgagggttatctggtggtcaccaatatcaacaatcccgagtccatcgacatctatgacaacgcccacaagcccgtgcgcagcattgcggtgccgccgcagttgaccggttatgagtatgaggtggccgatgcggccaacgcgctgctggacggcaagatcgaatgcgaggcgatgccgcacgccgacaccatccgcatcatggagctgatggatgcgattcgtgaccgttggggcctgaagttcccgtttgaatcctgatttcagctcccctccagaggggagctgaaattattccgctgaatctgcatctccttcaacaatctgctcatacagccgtacgaggcgttcgtcgcgcacggctttcgttaattcgcactcccatacggtaattacacgccagccagcggcctccagttcggctcgctgcgcgatgtctcgattgtgattgcgcagtagtttcgcctgccagaattccacgttcgatttcggcatcgaatgtttggaacatccttcatgcatgtgccagaaacagccgttgacaaacacgatggcgtggtatttcggcagtactacatccgggtgtccggggtaacgcttgtcgttcttgcggaatcgcaaccccttgcgaaacaggtagctgcgtaccagtacctcaattttggtgtctttgccacgaatatgcgacatcgtgtacgaacgggtaccccgctcatacttctccactggctgtttcttgcgattcacgcactccagactaccgtgacgttgcggcgagaatgagagcctgaacgaacgatcacccatcttgcccgtccgtgtctcttatcgcgggcaacaatcatctgccggtcgagactgcccgattagactgagttcaatggatgacatgacgattcgtagggccacggcggccgatattccccagatcgacgaactgctgcggcaggtgctcgaagtgcatcatgccggccgaccggatctgttcaaaggcggtgtcaagaaatacacggacgaggaattgaaggcgattctggccaacgatcagacccctgtgttcgtggcggttgcgccatctgccaatgacggcaatgacgccgaacataacgccgactcccccgccaccgaccaagtgcttggctacgcattctgcgtgttccagcagcacctcaacagcaatatcctgaccgatatcaaaaccctgtacatcgatgatctatgcgttgacgagcggtcccgcggccaccatgtaggctccaccttgtatcgctacgtgctcgacttcgcccgtcaatccggctgccacaacgtaacgctcaacgtctgggcctgcaaccccaaagcccaagccttctacgaacacatgggactcactccatatcacatcggcatggagcaggtgctgtagcgccgccgtgcacagcaaagtcgcctgaacggcgagcagaatcgcccattcccagaacatggacggttctttaagcaacgtggtctccggaaacatagacaccacctcattgataaaccacggcgccacaacaatctccacatatgcgagcccaatacaacacacgacaagcaccacggcaatggcatagcgccaagcgacgtctgttttgcgagatttacgagaaatgaatgcgataccagcgttcatggctatgctccttaatccaatatcaatatcaatggaggaacctgcacagcaccgtatgccaccatcataatatatcgaatatcgatataaagatatcgaaaaacactttcaccattcacccacacgcatcgcgacgtgatcaaccgttcttgccttgctcgcagcatccacgaccaacacgggaaagtcactttaaaaaagcaccttatcaatgtggataactcggaagctagaaccacatacccccgttcagcttgccaatcagagacctcatcccataccgtcaaatgcacccgcacgcaacgacgcgtcagacaacagaaagaaggaccaatgaacatctctacgtttacccacaactcccacccggcaattcgacatacgcattttgtctagtgcgggattgagagttatgatgacacgaagaaaactcatcatcaagaaacttcggcaagcggcaaagcagcgagggctcgatttctatttgttacggcaaggcagcagacatgaggtttactgcctggacgggttgaggatacccatcccccgccataatgaagtctcagaacgaaccacgctggatatcatcaacgagagcgagcagaaactcggaaaggggtggtggcaatgagcaactatgacgtgcttgtgcaacccgatgaccgatattggtacgttcaggtaccagctatcgaacggtcgacccaggccaaaggacttgacgatatcgagccaatggctaaagatctcatcactgtcatgaacgacgacgacaatccggagctcaaggtgacgtttgtgttgccgaaacaagccaaacaacacgtaacagaaatgttccggcagcgcgaaatagcaaaaaaagccaacgcacaagcggctgccgaatcccgactcgccgcacaggccctacgcaacgagggactcacgtatcgacaaatcggagctttattgggggtctcctaccaacgagcatttcaattggtcaacggcaaaacaaagcacaaaacgacagcgtccgaatcgcctcagccaacaactgaatcacgctccccacgcacgaaccatgccacaccgctatcgactccggtctcggcttagcgaacgggtccacaaagcccagactgtttccatccccaagctcaagagcaccgagcagaatcttctcatcccagcagattgaggagatcgtccttggtgagggtggcgatggaggcgggggcttcggtgagggcgctggcgccggtgccggcttcgtcggcaagcaaggaagcgtcggtgaactggcgggcgagctcgctcttagtatgctgaagctccaagatacgttcttcgatggtgtctttggccaccacctgatacacgttgacgtcttcggtctggccgatacgatgtgctcggtcggtggcctgatcctgtgcggcggcgttccaccatgggtcggcgtggatgaccacgctggcaccggtcaggttcagtccggtgttgccggccttcagggaaatcaggaaggcaggcgtatcgtccgcattgaactggtcgacgagttcgagacgcttcttcttgggcgtggagccggtgatggtgtagtagcgcaggccttgcgcgtcgaaacgttcggcgatcagatcaaggaagctggtgaactgggagaagatcagcgccttcttgccttcgttcacacaggtttccaccagttcggtgatgacggcaagcttggccgattgatccttggcatcggcgtacagcagcctcgggtcgcagcagatctggcgcaacttggtcaactcggcgagaatgcgaatcttcgacgtgttgaaatcggcttcttcgctgtgttcgagctgcattctgagccgctgctcgtgagccgcatacagtttgcgctgttcgccggcaagccgcacggtcagcgtggtctctagcttgtccggcaaatcggtcaacacctgggacttcagcctgcgcttgatgaacacgcccaccaacgactgcaattggcgagatacccgagcggcctcaggattgacttgtgcggcggcccgaccttcagccgtgctgccatccgcggcccgggcattggagatgggcaactcataacgctcatggaatcgcttatatgagccgagcagccccggcatcagaaagtcgaaaatgctccatagttcggagagtcggttttcgatcggcgtgccggtcaaggcgaaacgatggtcggcggccacggccttgaccgctttggctattttcgtggtgtgattcttgatgtactgggcttcatccaatgccatgacattgaaacgttgctcattggcggtgtaatcatcgacatctcggcgcagcaggtcgtatgaggtgatgagcacggtgggttcatccgcccggaacgcacggccgatggcggtacggcgctcggctttggtaccggccaccaccacggcattgaagctcggggcgaacttggtgaattcggcaccccagttgtacaccaaggacgccgggcacacgatcagcgatgggccaaggctgccgtcgcccatctcgccggtattccgctgatatcgagacaggagcaacgcgataagctgcacggatttacccaagcccatctcatcggccagaatgccgccaaaacccttgtcgcacaacgtgttcagccattgaaagccttcgacctgataagggcgcagaatatgcttgagactatccggcacttcatacgacttagggtcgatgatcttgagatcgtcgatgtattcggtgaacgaagcgtccttgactacatcggagccgtcatccggcagctcaccatccagtaggaatgctcgaccgcccggcaactcgatcagtccggagttgagctgctgctcgctcagatcgaggtcgctggccaatcggtccaacgtgctgagattcgcgccgctgagtttgacaagcgtgccgtccttcaactgatggaatcgttgacgccgacggtacgaagatagcaaggcacccacttcgtccggcggcacttcatcagcgaggggtgatatctccaccaagttgcctttgatggacaatccgactttgacgcttggtggcttgggcgcgatcagccggtcaaaagccggtgtggtgaagacctcccccacttcctttagtgccggcaatccctcgtcaaagagacgaacgatctgcgtggtgtcatcgcgatcgatagtggccgcatcagacacgaattttttggtggcctttcgcgcggccggcgttcggaacccattcaccgtctgatgagtggcggccgcaacgcgcttgcgctggtcaggcatggtaaagaattcacgcactacatcaatcgcaagatgctcagcgtcgaaatcacgcccaatcacgccccgagacaaggggatggaacgctcgccctcagcatgcaccgtcgggccatcgggtagcaacgggacaatggcatcgccgtagcgtgccttgacctcgcattgcacaccatgctcatcacgatccagataaaactggaggctgcattccgtagggcttaattcagccagctcgcgaggaatctcactggcctccaacagtccagcaccaaccagctgaggcaatagcgtgcgtgcgaatagggcgatgtcatcgccggcaatgacctgcccctcgccatcgggttcaaacaggtctcccaatagtcctcgcaacggaatcaatcgtttcgggcaacggacgaatcggcatcctgctgcgcttttacgctgagagcccgccatcatggcggataccgcaccggccggattagtggaggcgagcaacagccatacattcttgccgccgtcaatcacggtttccaccgctggcactccggtaagcaggtatccggcatccggaccatacgtattgaaatcacgccgcgcaatgcgcatgagaaaatctggctcgccaccatcaactggcaccgatgcaggctgcccggagaaccatgtgttcagcacgagctgtacgcctctgccctcacgtacggacagcaaccgggccacttccggtgctgaaagcgtcagatgacggtcgatggcgatatgcccgtaatacctgtcctgctgctcggccgcacgacgcacggccatcgcatcatcaaggacgtccagcagtgggcgcgaatcatcatcaagcatatccggcgtatgagtaaaggcaagcttctgcccataatccgcatagtcgccgttcgccatggcaagcacaaattgcggaatcgatttcagcacatagctggacccattggaagccgagccgatcttgaactccacgctccacacgccgtcgatgaaactcaatatcgggacaagctgcacctgccccaagcccacagtctcgctgtcaccctgatacccgccgcctcgggtgccggcacgagagccgtatccgctttttgtacgccgagcatttgcaccgtttttcccttgcgtggcatcaaaccgacgcataaccgcattgcgacgacgaattttggcttgagcgtcttgcctatcggcgtgctccatatagtcaatcagcgtccgagacggcctcacagccccggcacggtagccttcaaaacgctgcggatcatcgcagaatatgaaggcgagcgcaatcatgtgcttgcacatgccatagccacggccgtaagccgggcatgagcacttgccgccgacctcctcccccgtatcgaggtcgaattgcacgctggtgcgatacctacttgatgggctggtggtgccacgtagaataccgtcaagttcggcatacccggttcgatgattttcgctgtataccggattgataaccatggtggccgctttgcgcgcaatgctacgggcacgagcgagcacggcattcgacgatgacgattccacatcgttgcgtaacgcaaggatagggacggcatgggcttcggcacgcttcgcagacccggcgaaatggccttcgtcctcatcgtcgaaccatacggaacgtccttgcctgagacgatagggcatcaccgcatcggcggcggacaaactgtccgttccaccaaacgttacgtctctgctgccggccgcgcctgagctaccaagtattccacccgtctcaccagaaatgccgcctactccgccgcttttaccggcatagatgcccctgcccccattagtgtcatcagtgtcatctatgtcatagcgaccgtcgtcgtaatcggcatcttcgtcgtctcctcttttccaaggattgcgacgacgcaacgcatggccccaggaaacgccggaatcatcatcctcataaggcaggaggccatcgtcatccgcattatcgggaacatggccaaacacaccataccctttgctcatgggcgagcctcctttccagcgaatgtatttcaacccaacgtttccatcctagacgaagcgcgcggtagccttaatgtatggatgcagacaagccggcgcaacgcaaatcctatgcagggaacaccaccctcgaaatcttcgaggtgctgtggcgtcacagttactttgggcatggcctgaccgtgcggcaaatactcgatgagcttgcccgtaaacaccagctggaagatccaagcgagctgccgaccgagaagaccatacgaaaccagctcaaaaagctgacctccacggaatttctcggcagacatatcgggcatctcaccgaaagcgaccttgccggcatcgaatgcaagaatccacaacccggctggtatcttgatgcattcctgtccactgccgaaatgcgactgctactagacagtcttaccctatctcgcatcagcctcgacaccatggacgacctcatcggtaaaatccgcgagctcgcaggcgccgccgggcaggcagtaggctacctggaccatgtggccacctacacgcatatcaacggtgagttcctatccactatcgaccagctgaatcaagccatcgaagaaggccacggcgtaaccttccaataccgtgattacggaccggatggcaccttgataccgcataaaagccgtacgggtgcaggccgaattacctacaccgccgacccttaccagatggtgtacaagaacggacgctattacctcatctgccacctgcatggcgaagacaacctccgcattttcgtggtcaaccgaatcgccaacgtcagcgccaaaggcaggaacggcacagtgccactggaaaaaccagcaccagctgattttgacgcagtgaacttcatgcgccaccgtccataccccgtagccgatgccccgattcgcatccgcatggccgtacgagacgaatccatgctcaacaacgtgttcgaatggttcgacgaccctcaaatcaaacattcaccggacggcacacagttcgaagtcatcgtcgatgctcccgaacgcgctgtgttctggtgggcattgcagtattcctgggatggccgcgtagtgattcttgagcccgattcgctcaagcgcaaactctatgatgccgggcgtcgcatggccacagcctatgctcccgaatgatgcaacatcacatcgcacacctccttgtcgagttgttcaccagcgaatttcaccggagaacctatcatcccatcgccaatcacactcggtaattttttaccgggaaatacgatttcaagccatttcgcgggcatcgtccctcacccaggcgcacataaggctaaggtgggaatcattaatcgcatcgcgcgtccacaagcgtgcactagcgcgtacaacaataaggagcaactatgagcgaagagcgtaccgcatggggctggggtctggccagcgtagacgccgccggcaccaccctggacgtctggtaccccgaactgaatctcggtgaggcaccggccgagtccgatcgcccgaaccacaatttcggtactttggctcacgatgaggccgacgcccgtggcattcgccgcgtgccggtattcgtcgtcagccagttggacgagccgatcagtaatgccgcggacgcttacctgaagctccatttgatgagcatgcgcatggccaagccgaacacgctgaacctcgacggcatcttcgcccagctcgccaatgtggtgtggaccaactacggccccttcgccgttgaagacttcacgctgcgcaaggccgacgtcgaacgcgcctccaccgaagccgctctcgctttcgcctcccaggccggactgcctgccgcagctcctgccgccactgtcaacgtgttcggtgtggataagttcccgcgcatgatcgattacgtagtgcccaccggcgtgcgcctcggcgacgccgaccgcgtgcgcctcggcgcttacttgtcttccggcaccaccgtgatgcacgccggattcgtgaacttcaatgccggcacgctcggcgtctccatggtcgaaggccgtgtttcgcaaggcgtggtcgtgggtgacggttccgacatcggcggcggtgcctccatcatgggcaccttgtccggtggcggcaagctgcgcaattccatcggcgagcactcgctgctcggcgccaacgccggtatcggcatctctctgggcgataactgcaccgtcgaagccggtctgtacatcaccgccggcactaagatcaccatctgggacaaggccaaggccgccgctggcgaaccgctggaagtggtcaagggtgctgagctctccggcaaagacaacattctgtttatccgcaactcggtgaacggccgcatcgaagcccgctaccgcaaggtgggaattgagctcaacgccaagctgcacaagaactgaaattgaaataatggagcgttatcttcgttgcccctcggtcgacgtaccttcgtacgccttccctcggtgcgcctcgataccgcacacattatttcaatttcagaactagccctgctagttcttatgcagccgtcgcagcatagctggtttgcgctgtacatatagaaagcgcctcactggaatctccagcgaagcgctttctcaaaccaacaatcaccgctcgtccatcggcacgaaatcgcgctcgaccggaccggtgtagacctggcgtgggcggccgatcttggtattcgggtcggccaacatctcacggtactgcgcaatccaaccgggaatgcggcccagcgcgaacagcgtggtgaacatggccggatcgaagccgatcgcccgataaatcaagcccgtgtagaagtcgacgttcggatacaggttgcgcgatacgaaatattcgtcattcagcgcaatatcttcaagctcggtggccacggcgaacagcgcgcgctcgtcagacggcagcttctgcgtatcttcgcgctccatgatcttttccagatacttcctggcaatcgccgcgcgcggatcatacgacttgtatacacggtggccaaggccggaaatcttctggccattctccttggcatcacgcacgaactcggccacagacttgccggaatcacgaatcgccttcaattggcgcagtacggcctcattcgcaccaccatgcaacggaccggacagcgcattgacgccagcggccaccgccgaatacaggttggcgtgggcggaaccggcgatacgcaccaccgaggtcgagcagttctgctcatggtcggcatgaataatcaacaaacgacccaaagcatgcacatacagcgggtcggattcaaacggctcgtacggcacagcgaagcacatgcgcaggaagtcgtccacatagccgcgcgcgtaatcggggtacagcatcggctcatcgcgacgacggcggaagatgtacgacacaatcgtacgggccttggccatgatgatcttggcggcctcatcaagctggtcgttgtcagaaatatcggtggtgtccgggtagaacgtggccagcgcattgatggcggaggcaagcacgctcatcgggtgagcggagcgcgggaacgaacccatgaaggtacggaagtcttcgccaaccatcgtcttgtgattgatgtccgcacagaactgctcatactcagccctgctcggcagctcgccgtggcgcagcagccacgccacctccagaaaatcggagttctcgcacagttgctcgatggggtaaccgcagtagcgcaaaatcgaatgcttgccgtcgatgtaggtgattttcgattcgcactgcgcggtggtgaggaatccgggatcaagcgttacccagccatcgttgcgcagtttggaaacgacgatgccatccggccctgcactagccttaaccacgggcaggttgaacttgttcgaatcgacatcaagttgtgccgttgccattcgcgcaccttcctcttcatgaaccacttaccccaaacattaacgttcacgcgttcgcgaacactagtgttcggtactctatgtcttctgtgttaccgctggcgaatgccggtcgatacacgaaagccgaagtgcgctcatgctatcaaagcaaacgcacttcggcttgttacgtctcgaattcgcgggaaaaccgcgaacagacggacggctaatgagacgctgatcgcccatcacaggccaatcaggcacctaccatacgccaaacgccgatcagaggttggtgcgatcggtgaagacgatcgggccgttctcggtgatggcgatggtgtgctcggagtgggcgccgcgcgagccgtcggaggcacgcagggtccagccgtccttcggatcctggaagatctcgtcggtggtcttgaggaaccacggttcgatggcgatgaccaggccttcgcgcagcttgtagccgtggtgggcgcggccgtcgttcggcacgtgcgggtcgccgtgcatgatgtggcccacgccgtgaccgccgaactcgaggttgatcgggtagccgtattcgcgcgcgacgtcgccgatggtgttggagatgtcgccgagacggttgccgggcttggccacgtcgatggcggcggcgagcgcttcctcagtgcacttgatgatgcgcaggtcttcggggtccgggtctttgccgaccacgaagctgacggcggaatcggccacccagccgtccacagagatggcgagatcgagggagacgaggtcgccgtccttcaggctgtagtcgtacggcacgccgtgcagcacggcatcgttgacggaggtgcagatgtagtgggcgaacgggccggtgccgaagtcaggagcgtagtcaacatagcaggattcggcgcccttgcggtccacgatcttcttgtggacgaactcgtcgatttcgagcaggttggtaccaactttggtggtctcctgcagttccttcagaatgccgccgacaaaacgaccagccggcttcatttcctcgatttcacgaggggttttcagttcgatcatgagattctttctaccttgttgagacttgttctcaactctagaccagcccgaggtcaaccgccagaagcctacctgaaatccactcgcagcccattaatagccaaggccgagaaaaagcgcccggcagcacatagcctgcacgggcgctttggattgattgtctggggactggttgcatgaagcgtgagattacttgcgacgcttgccgaaagtgaacgcgcgaatcactgaagtaatccccatcaccaccatggcgcatccgccgaagataatcatgaatacggcggagctcagcgggctcatcagcaccacgaagccggcgataatcgagatgatggcataggcgatggcccagccggaatgcgggatacgccacgattcaaccagcgacagcacgccttccataatccatccgaaaccgaccatcaaagtaatgagtaatgccagcgtctgaccggtcatgccgtagttgcgcacaaccaccacgccgccaaaggtcagcagaatgccgacgaacacgtccagcacacgccagccgcccggcagacccggctccacgagagcgctgacgatgcgcaccacgccggaaatcacgaaatacacgccgagcaacaatgcggccaaagccagcgtcttgttcggcaccagcaacagcgcagcgcccaaggcgatggcggccacgcccaccacgccgtaaatgatgcgaatcttggtcttggctttttccggcagccattcctcgatcaggcggaatggactgaaattgccgacataccagttggtctgctgccagccgggttgactttgatcgccccatggaccattcggctgcccgtccgcttggctattcgattggccgtccgcctgataccgccgaccgtccggcccccatgccggctggccgttcgggccatagttcggattgtaggcgtacgggccgtagtacgggttctggttcggttcgccttgtggctggccgttctgcgcatgctgattctgagtgtcttgcgctcccggcgcaccttgcggaggatattggccgccatgattgctgtcatacgcaccatactgcggttggcccggttgacccgccggattcggctggttcggctggctctggttgggctggcccgtctggccattccactggtcctcgttcggattgctcatcgtaactccttagctcaaggtccatgttcagattccacatactatgatagacaagttgtctaatttgaaccatcaccacaattaggcaatctgtctagttcactgacagcgcaatgcccataacgcaatatctgcaccatcaacgcttctcccccgccgcgattaggcttagggccatgaccaacgaaaccgaaacgctgacgtcgggcatcgacccggcatcgttctcctccgtcatcaagccgaccaacgacctgttccgctacgtgaatggcccatggatcgacacctaccgattgcccgacgatcgttcgcgctacggctccttcgacaagcttgccgaagacgccgaaaaccaagtacgcgacatcctcgacgccgacgactgcccggctgtcaagtctgaggccctgtaccgctcattcctcaacaccgacgccatagaggccgccgggcttgacccaatccgcgacgagcttgacctcatcgattccgccatcgacaaggccgctctcacgcgcgtgctcggcaccatcaacccagccggcggccccgacctgttcggcttggccgtttacggcgaccccggcgacccggaccgcaatatcgcccaccttgagcaggccggcctttgcctgccggacgaagcctactatcgtgaggaccactacgtccccgtgcgcgaagcatacgtggcgatggtcgccacccagctggtgaacgccgggtacgcgcccgccgccgaatccaacggtggcgatgagctgccgtccaacaccggcgatgacgagagcaacgctcccgccacggttcccagcgaagccgcgctcggcatggcccgccacttccttgccgtggaaaccaagatcgccgccaaccattgggacaatgtggccacgcgcgactcggtgaagacctacaaccccaccgattacgccgatctggccgccacgctgaaaaacttcgatctcggttcttggatcgacgcttggcagaccgcttatgacgccaccgaagccgccaaggctcagccgattgatttcaagtctgtgttcgcgcgcgtcattgtgcacgagccgagcttcctcactggtcttgatgcgttctgggccgaggccgatctggccgaccttaagctgtgggcccgtgttcacatgattctgggcttcgcctcctccctgtctcgcgacttcgacaccaccaactttgacttctacggcaaggtgctctccggtgccaagaagcagcgcgatcgttggaagcgcgcggtgagcctggtcaacggcatttgtggtgaagatgtgggccgcgaatacgtgcgcctgcacttccccgaaagctcgaagcgccgcatggaagagctggtcgccaatctgattgacgcctaccgcgtgtccatcgccaattccgattggctgggcgaggacaccaaggccaaggctctggagaagatctccaagttcacgccgaagatcggctacaccaaccactggcgcgattattcggcgctgagtgtttccgcggatgcgctgcccgccgagaacgccaaggccgcgaacctgtacgagaccggctatcagctggccaaggtcggcaagtcggtcgacaaggacgaatggctgatgaatccgcagacggtgaacgcctactacgagccgagcatgaacgtcatcgtgttcccggccgcgattctgcagcccccgttcttcgacccgaaggccgaggatgcggcgaattatggcggcatcggcgcagtgatcggccacgagatcggccatggcttcgacgatcagggttcgcagtacgacggcgacggcaagctcaacaactggtggaccgacgaggatcgcaagaacttcgaggcccgtaccggcgcattgatcgcccagtacaacagctttgtgccgctgcagctggccgagaagtacgctgacgagcctgataaggcaccgcacgtgaacggcgcgctgaccatcggcgagaatatcggcgatttgggcggcgtgaacatcgcgctcaaggcgtatgcattcgcgctcggcaaggcggcaggtaagtccgacgccgaagaagacggctcccccgccgccatcaaggcactgctcgataccgcccccgaaatggacggattcaccggcctgcagcgcttcttcctgagctacgcctccatctggcgcaccaagaaccgcgacgagctggccgaacagtacctgcagatcgacccgcattctccggccgaattccgcaccaacggcatcgccagcaacgtggacctcttctacgatgcctttggcgtgaccgaaggcgacgccatgtggctcgcgcccaaggaccgtgtgcgtatttggtaatccccgttatgtaaaggaaaaccgctgtgtttgcctcgattacaggcgaacacagcggtttttcatgatgtatggttggcactcagaattcggattcgctgggattggaagattcggcgaaaccgtcgacgtaggtttgttgggccacgggctgtggttgattggtgtcggcgtccggttgcgacatgacggcatcggccatggacgcagccgctgactcggttgatggcgacggcgattggccggaatcggaggtgaccccaaattcgacggggccagattccgacgaggtcgcatacgggtcaatgcccacaccggatgcggcaccgtccacactatattgcgttggcctcatgtgcggtgacgatgctcgttgcccgtttccgccatccatgccttcggcggcaccgttggcattgccgttaccgttgccaccattgcctccgttcccattaccggcacgctgtggcttgatcagcgacgtggtgccgaaggtcaggtcatgcccaatgttggtggcttcgagaacggttctactgcgcggttcgccttgctcattggtccactgctcggtgatgagtgagccgaccacaatgatgcggtcaccgcggcgaaccgaactggcggcgttcacggccaaagcacggaacgctttgacgcccacccatgcggttccgtaatcctcccattgtctggtagtcgggttgagtcgactgcgggtgctgcccatacggaatgtcagcacgcggaagctctcggttccgcctagtgtcggatcaccggccacaaagccggtgacggtcactgctgcttgttgatttgccatgatcggtcctttcctcggcctgctggcctgttgtttggatgtggaccgccggagcctgtctccggcttcattgccggcttgcacgccccagcggtacctccactgtgaggcatgacgtttgaagtgcacaagggcaactggcaaatgtggatactgtgacgcagttgaatttttaagaatgtggataagtttcggttatccacagcaaagcgccattctgcgactgggcagaatggcgcttgatgcgattaacgccgaggctgagtaagtgggactcaactgagggcggcgaagcgctcggcgagcgcgtcggcggcttcggcggcgggcacggcgaccttgttttcgccgttgcggtcgcgcagttcgatggtgccgtcgttgacgtaatcgcggccgaccacggcgaccagcggcacgccgatcagctcggcatccttgaacttgacgcccggagacaccttcttgcggtcatcgtaaataacctcaaggcccttggcttcaagctcggcgaccagcttctcggcaccttcaaacgccacggcgtccttgccggtggccaccacgtgcacggcagccggggcaatcacggacggccaagccaagccggcttcgtcgtggtgtgtttcggcgatgcaggccagcacgcgggaaacaccgatgccatagcagcccatccacaccggcacggccttgccgttctggtcgagcaccttcaggtccagtgccttggagtacttgagacccagctggaacacctgaccgatttccacaccacgctcgaagctcaacggaccggaaccatccgggctcatgtcgccgtggcgaacctcaacggcttccaccacgccgtcgaccttgaagtcacggccgtacaccaggttgtagtagtcgacctcgttctcatcggcaccagtgaaccaagcggaacccttgaccacgtgcgcgtcgatcaggtagcgaaccgggttcttcacgccagcagcctcggcctgcgggccaagcaccatcggtccgatgtaaccgggcaccagttcggggtgctgcttcaggtcttcctcagtggcttcctcaagttcggcgggcgcgaactgggcttccagtcgcttcatatccaccgtacggtcgccgggcacgccgacgacaatcacttcacgccacggctcgtcatgctcttcatcctcagggtgcttgacggtgatcaccacgttcttgaggatgtcggaagcctgccattcacggccatcagtacgcgggtggtcggcgttggcacgctcgatcatgttatcgatggtcttggcatccggggtggcttccttggaagcggcgggagtggtggaagcatcgatttccggtagttccggagtgctcagggcctccacattccatgccttgccggaaggtgccagcgcgaaggtatcttcgccgatcggcatcggagccaggaactcctcggatgcggagccgcccatcgggccggacatggcgaacacaggtacgtacttcaggtcaagacgctggaagatacgctcgtaagcgccgcgctcgtcatagtaggccttgcgcatgccttcttcatcgatggtgaaggagtaggcgtccttcatgacgaattcacgaccacggatcaggccggcgcgcggacggaactcgtcgcggtacttggtctggatctggtacagggtgacgggcaggtccttgtaagaggagtacatgtccttgaccagaagggtgaacatctcctcgtgggtgggggccagcaggtaatcggcctcgtggcgatccttcaaacggaagatgttatcgccgtactcctcccagcgatgggtggcctcgtagggttcgcgcggcagcagggccgggaagtgcacttcctgggcgccgatgccgttgatctcctcgcggatgatggcctcgatcttgttcagcacgcgcagaccgagcggcagccaggtccagataccgggtgcggccttgcggatatagccggcgcgctgcagcagcttggctgaatcgacatcggcatcagcggggtcctcgcgcagggtgcgcaggaacatggttgacatacgaagggtattggaagtcatgtgttccacgatattcgcgtgaaccgacaagcctgcatatgtcggctgctcaaccttccgcgctgtaccaacgcacaggaatcacggataactcatgcaggattcatcatcttggttttcagccctcgccatgcgccaatgaaatggcaatgaaggggcaggggcatacaatggcgcaaccgcaatattctccattccagccacaacctgagccggaacatccgccgataaacagtcagacacagccgtcgccatatttttcaccgcagacgcaattggcacaacaatcagtgccgcaatccgcgccgcaacctctgccgccaaccgcgcaagggccattcccgcagcggccatcacagctaaatcagccaaatcaacccaagcattccagcattcaaaattagcattcacccttcttgataagcttgtgatcatcaccatcgcacccgaacaatagctgggaattagcattcacccttcttgataagcttgcaccaaacctcttggaacacatcgacgagctgggaattagcattcacccttcttgataagcttgatcttgaaatacttgcgttgcacgtcctgctgggaattagcattcacccttcttgataagcttggtttgcaggaacggaatctgcacttctagctgggaattagcattcacccttcttgataagcttgagaaaccgaggtacagagatggacgacgagctgggaattagcattcacccttcttgataagcttggacatgaatatcaggacaataatactgtgctgggaattagcattcacccttcttgataagcttgaggccgcgaagaggccacgatgaatacggctgggaattagcattcacccttcttgataagcttgattgaaaactattatgaccgattacaacgctgggaattagcattcacccttcttgataagcttgaccagacacgcaaccctaccggcctcgggctgggaattagcattcacccttcttgataagcttgaatctaatgtgctttttgagcgtaaacagctgggaattagcattcacccttcttgataagcttgccactgatgaaagacacggacaagctcacgctgggaattagcattcacccttcttgataagcttgtgcagtatgcggatgaaggtgtccctcacgctgggaattagcattcacccttcttgataagcttgcgttggccaacccgtatttcagcgcattgctgggaattagcattcacccttcttgataagcttgactgagcgtgttccagcgcgcatctcaggctgggaattagcattcacccttcttgataagcttgggaaacatatgcactatttcatcaaaatgctgggaattagcattcacccttcttgataagcttgcgagcgactgggaccaggccaacaggttcgctgggaattagcattcacccttcttgataagcttgatggatgcaatgtctactattgtgactcgctgggaattagcattcacccttcttgataagcttgcgagcgactgggaccaggccaacaggttcgctgggaattagcattcacccttcttgataagcttgttatgagggtggtgggatcatgcctagagctgggaattagcattcacccttcttgataagcttgggccgctagaacagctttccggcgttctgctgggaattagcattcacccttcttgataagcttgaacgccacaagcggcaagaacaacctacgctgggaattagcattcacccttcttgataagcttgtaccggtgcattttgcgccgcgtcatacgctgggaattagcattcacccttcttgataagcttgccatctgaggtacggtagctttgtgtgcgctgggaattagcattcacccttcttgataagcttgttcgatgtcatcccggtatcgcagattaagctgggaattagcattcacccttcttgataagcttgtgccgcgtgccggatcggtgccatctatgctgggaattagcattcacccttcttgataagcttgtattaatgctcataacaaacctcctctagctgggaattagcattcacccttcttgataagcttgcctaccagcagcggatgaaggcgcaacggctgggaattagcattcacccttcttgataagcttggataatgtggtcacgtttaaatcagccctgctgggaattagcattcacccttcttgataagcttgaaacggctggagattcccggtgaacaatgctgggaattagcattcacccttcttgataagcttggcctcggccgcgcacacgtcacaacgaagctgggaattagcattcacccttcttgataagcttgtcgtgtagttgcccatcacgtcggtagagctgggaattagcattcacccttcttgataagcttgatagcctatcaagaagggctatttttcaatcttttcagactctcctacgttcaaaaaagcgtgagaaagtcaggcgtttcttcctcaatctcacgttttccagaagaaaatcgggccgccgtggaccactgatgatcgctaatatgcaaaattctaactaagccattagctggcagattgtctttaatcattttgaccgtcgccctattacccgattgcgtaggcgtataccgcacatatacggaatactgcaccattccatatcccatgtcgagcaacatatttctaaagacagttgcagcatgccgttgccgttttgtcttgaccggcaaatcaaacatcaccaagcaccacatgccgccactgtcctcatcgcgtttcatgactcgcctacatattcgggaacctgcaacctgtcgattttgccttcgcaatataaaccaaattgctgcgcaaaatcattcaatgagctcggtatagtcaaaccggaaccgttgaattgttgattcacagcatctaccaaatgcttctttactgccttctcctgcaacgagtcttcatcattcagcagtgagactctgtaatccactgccggcctatatacctccaacagatcatctgcaagacagaaataattgccgcgcccgtgatgattcacgcctaaagatggaattaatcctgctgctatcaccgctttaaccgcgaatcctcgcagcaccatataggcataatccaactgcgcattccgaccataaccctgccccggaatccttctgaatttctcatcttgaggaaacattcgcctccaatattcacgtgcagcatgaccttcgcaattggaaggatcacccgaacgaacagaggctgcaatacctcgtagcaagcctccaccttcgagttttgatgaatcgaggcaagcagcttgtccacgaatcttcatctgtacaatacgcgcccacgcacttttcttgcgaggaagagacatgttcgactgcgccaattgccgcgtggtaactgtggtaggcatgtcagtccatgcatgcagcgcagcgtcaggaacaccacgccaatcgcagagcatgactgacacgccataccgtgccatctcatgtaataccgcagccgaacatcgcacatgcaatcccagtagcactaccgcaatctgagcaagtggcacatccacgcactcccctgtatcgttcttgacgactcgcatccttccccgttcataggagatggagccgtcaagatcggtacagtcgattacacgccactggttttgcatgattcactcatgcctccactgccatgagcacggcatatggtgtgccgacgataatctcggttcgccaaaagcattgcgtcttacgatacgaaccgcagtcttacttgctgtattaaccggaggtagccatccttgttttgtcacaattttctggaccccatctggaacaacatcgtcagaaaacgcttttgccaatccttccgcagcaaggtatcgaggtcttatcctcaactgcgtctggttaaagaatccatcaacaacccaatgtttccatgcaaggttccctccactaaactgcgagaagaattgtaaatactcgccaatctgaccatcaacatcgagactggaaaaatccatctcgatttcatcaccgacaaccaacgaccccaagtactgagcattaccgctttgcagcgcctgcaccaccctaggctcgccataccgcatcgaaatagactgcgggggcaacggcacggtaaataaatcatcatggcaagcgcgtagcagatcagtttggaatacgcgaatcatgccatagaaatatttacgaactcccttggcattcgtcttccagcaccggtacacgcgggcatgatgaatcgccgaaccgatatctgcagacccttcctgcacagcaatctgcgcagcttgcgacgcgaagaatcccatctcatcgtcagcggaataccgagtatcatgcactcgtatttcacgatgtgaatcttccggcaaaccctctttttcatcataatccggcaaacgcgtcaaagcacaccacaaggccggtgtagaagcacgtcgaataagatccgcgctcatcgccgagcccaacggcactttttcgagcggatgaattgtggcatcatgtgctatggaattaccaaggacataacgctgcgattgcatgacagcaattcgatcattgtccaacgcatcattaagcagctcaagcaaaacgtccatattatccaaccaaagatggaacgattcatagcgtgaagtgccctcataggggtattccttccatgaacgttcgcctggcatgagaccaatcaaacgctgcgattctctcaatgattcacgttccatcaacgtctgcgcagcagccgtgttcatcatcgcgataacggaagcgtccaccgcatgatgacgacgatccagacgagtctttgattgctggccaataaagtgtatcttcccttcaatgccagctgcacgtcttgcagatgccgtgacacggccttggaacaccgacaccgtggttttcattgtctcggcttcagcatcatcgattgaagcagaattcacatactgcttcgcattgaaataccaatcgatacggcggtggagttcatcagccatccaagccactgattcgatggaacgattatcgatggcagcatcatcttccgtttgctgaagccttgcgattaccgcttgcttgaacgctttcacttcccgaggagcatatgacttgggattgaaagtaaacattgtcacacgctttttagcttcagcaaggcttacccctcgagtttgggcatcctcgctccttgcccaaatcgcaaatggagtgttcgatttcatacgattgcattcggcacataccgcagcgaaattggtcctcgtgttcgtagagccgacgcctttccggggaacgatatgatccatttcgcacgtacggaatgtaatcgtacggccgcaatacaggcactgtccattttgacgctgaatggcttccaatctccgtaaatcggattcacgcactttttccatctgctcatccgcgcgaagctgttcactcaacgagctgcggaatatcgaacgcttctcattgttcttttcatattcacgcttgtctttgcgggcaaaggcaaccgacgagaacgaagagcgcacatgttcaatgttcactgagacgggattaccccagcgctgctgacaattcatgagatatcggttgacgtttttcagcacacggtcgaccgatggattacccagaggctccccaattggatctgccggcggacgccaactatccgtaacgttgaacagcgttttacgtgcttcgtgcaaatcatcatcagtagtcagcatctgacgagtgagtttttgcaaagtttcaacactgtatgcagcacgaccggaggggagatcaacggagtcaagtttggttaacgcatcatcatctaatccatcgataaattcaatcgcagaagcatacgccacgtcttcacgcaccttatcgatatccaccgtattagacagcaggcgaatcattgcctcatgctcattgtcagacgcggatttccaccaggccaccaacggtttacgaatcttgttgtccgactcgtaaatacgctggactgaagtcaatcgaggcggacggctggatatacgttcttctccatcctcggtcaagctacccacgcctttcaactggctccgcttgaagccgaggaaatcgcataaatcagaccatgtgatatcttccgaagaaggtgacacgagttggtcataaatgctttgcttctcatcaacagtaagtttgcgaagttctgcggaagcatccttgattcttaggttcgtaatcacattcgcgatacgatactcctgaaaagccaaagaagcctttaatgccctagcctgttcaggagccagaggatcctgaccgacacgctgctctgccgaacctttaggagacaccgcataaaacacactacggaacagcggcttccactcatccgcgggcactctctggaccctgaatatttgcttcagctcgttagcattatcttcctgcatcaaacgtaccggcaaatagccttccgcatccggttttttagaaccggtacgccaacgcagtcgaggagcttccgcatatccagcatccaacatcgccaccactaactgcgcgggagtgctctcttcttccgcagcagttgcgtcatcgttgtacgccttcgctttttccttcagttcgccatattgcttcgaatatggattgtcgctgatcagcgagtccacctgacgataaggattgcgccatccgcgatgccttgccatatgtctcaatgcgatagaaatactctcacggcgaagttcatcatcttcgatgtatcgtgtagccagctcagcccttacatgccattcttcaaagggcttatccaaggactccggctcaataacggggtatccaaatttgccgaggagcatatcgagcttgtgcaagcgctcacgcttccgacgcctcatacgccgcgtgcgacgagcgacacccgacatattctttcgcgtaatcgcttccttattcttctgaggatccacaccaccatcgtggattacgctttgcgcattcaacagacgcactggactgttctcatcggacacttctactgcggcaaggcccacagaattcaaaccgacgtcaattcctatccggtaacgcttcccccgcataaaacacctttcaccgtagctacaatgcacatcattgtcttgaacattgtaactgtacgaaacagggcgagccaaatggctcgcccctagcagttgcctgctgagcattcaaagtggctatcaggtccactcttactgagaattagctgtatcagtatagcgcaaatcctcttagcgacacaacatgaatcatgtcagaacaacgcgtcctgggcgaagtcatcgtcgggattggcaccgaattcgtccggctcggcgggtttgaacgcgtttgcaccttcatcggccaactggtcggaggccgcggccgaggcttcgcgcaggtcgccgtcgagcaccacggcatcgggcgagacgaggaacatgcgttcgttgacgccggccaaatagaggccgcccagcgattcgactcgggacagcgccacatatcccatgcctggcgcgaaggtgcgcttcaggtccatgaccgcacggtcaagcgtcatgccttgcgacttgtggatggtgatgccccacgcgcagcgcaacggcacctggaagacggaggcgagcacggtgtcgccgtccatcatctcccatgtggcctgtttcatggtgacgatgttgccgttctcgaattccacgatcggccagccgcccttgttctcctgtgcgaagccacgcacggtgccgagcgagccgttgacgtactggcgatcggtgtcgttgcgcagggccatgacagccgcgccttccttgagtatcaatcgctcgggggccaacatgttctttttgagtcggtcgaccaggttggcagggcctgctgtctcggcgtggaactcgtgtggatcaagcatgatctggttcaggcgcatgtcgttgagattgtcggcctgccggttcaccgggaacaggtggacggcgacctggccgggctcgggcagtttgcccagacgagtgacgagcacgtcacggtcggactgggtcacgtcgccttcgcgaatgtcggtgagcacggtcagcagttcgccggtatcctgacggtgctgttcggtcagatagcagatcaccgggttgagttcgggccataccagcgattcggtgatgaagccttcggggttcaagccggcacgggcataccgttcgcgactggcgatgaattcgggcgtgggggcgatgaggtcgcggttgcgcccggacaccgaaaccggcggcagctggaagaagtcgccggacaagacaacctggatgccaccgaacgggcgtggatcacggcgtacttcgcggcagacttggtcgaccatgtcgaacagccaagcgtgcagcatggaaacctcgtcaatgacgaggatgtccgtggcctgaatcttgcgtttgcgccgggatttgatgagtttgagcaggctggcgctcagggcggtggccacgccgacgccgctccacgaatgaatggtttggccgttgatatgcgtggaggcgatgcctgtggacgcggtgactgctacactggcgccgtcggcccgagcctggcggatgaactcgttcaagacataggtcttaccggcaccgggcgcaccggtcaggaacacgttcgcgccggcgttcagaatggccagggcttcggtttggcgcatatcaacctctctagactcccctcagggaggggagccaagtacggcggactacttattgaggatgctggtggctacgatgtcggcggcgatggccttggatgcggcatcgtccgggccgggggcgggagccataaacgccttacggtagtagcgcagctcgtccaaggactcgatgatgtctgcgagagcacgatggccaccgttctttggcgggcggttctcgtacacggccgggtaccagcggcgggcgagctccttgaatgtgctcacatccacgctgcggtaatgcaggtggctcatgaggttcggcatgtaatggtcgaggaacttcttatcggagccgatggtgttgccggccagcagcgggcgcacgccttccggcgtgaagcgcagcacgtattcggtgaccttctgctcggcctcggccaggctcaggccattctcccactcgttgatcaggccggaacgggtgtgcatctggcgcacgaaatcgttcatatggttcacggccttctcggacggcttgatgacgtaatccacgccctcgtccagcacattcaggtcaaagtcagtgggcactacggacacctcgacgagttcgtcgccgccgaagatatccaagcccgtcatttcgcagtcaatccaaatcaggcgcgaatcctttgcgctgtaagtttctgcatcatggctgtcgaccatggtaagcctcttttcgtcatgtcacccgttattacaagaacagttcagactataccccagcgcatacaagctatctcgagccacatacgcgaaaagggcctgcataagcagacccttttcacaaggaatcaacccctaactagcgcaagctagcgggcatcaaccgatcagttgttgtggaagccggagtagttcggggcttcggtggtcatcacgatatcgtgcgggtgcgattcgcgcagaccggcgtcggtgatgcggatgaacttgccacgctccggcatctcggcgatgttgtgggcgccgatgtagaacatggactggtgcaggccaccgagcatctggtagagcacggcgttcagcggtccgcggtacggcacttcgccttccacgccttccggcacgaccttgtcgctggaggtcacgtcggcctggaagtagcggtccttggagtaggacttcttgccgcgcggggccatggcaccgagggagcccatgccacggtacagcttgtactgcttgccgtgcaggagcaccttctcgcccggggcttcctcacagccagcgagcgtgccgccgagcatcacggaggaagcgccagccacgagggccttggcgatgtcaccggagtagtggatgccaccgtcggcgatgcagggcacgccagcggcacggcaggcctgggcagcctcgtacacggcggtgagctgcgggacaccgacaccggcaacgatacgggtggtgcagatagagccggggccaataccgaccttgacggcgtccgcgccagcctcaatcatggcctgagcaccggagcgggtgccgacgttgccgccgatgatctgcacgccgtcgaaggcggagtcgtgcttcaggcgggaaatcatgtcgagtgccagacgggcctcaccgttggcggtgtcgaccacgagcacgtccacgccagcctccatcagagcggaggcacgctgccaggcgtcgccgaggaagccgacgccggcggccacgcgcagacgaccctgctcatccttggtggcgtccgggtactgctcggtcttgacgaagtccttgacggtgatcaggccggtcaggtggccttcctcgtcaacgagcggcagcttctcaaccttgtgctgggcgagcagacggtgagcgtcgtccttggaaatgttggacgggccagtgaccaggttctccttggtcatgacatccttaaccttcagggtgtcgtaatcctcggaggcgatgaagcgcatatcacggttggtgatgatgccgacgagcttgttttccttgtccacaaccggcagaccggagatgtggaacttgccgcacagcttgtcgaggtcggccagagtgacctcggggttgacggtcagcgggtcggtgatcataccggactcggaacgcttgaccacatcgacctgagcggcctggtcgtcgatggacagattgcggtgcagcacaccgataccaccgttacgagccatggcgatggccatctcggactcggtcacggtatccatggcagcggagaggaccggggccttcatcacgatcttgcgagtcagatgagtgctggtgtccacttcggagggaatgacatccgtctcgttcggcagcagcaacacatcatcataagcaaggccgagcttggcgaaaatcggaggaaggggagcatacgccgattgggcgttcaattcatcgaggtttgtagccatacaaacactatatgaacacgcgctgaccttcacgacacacgcttgtgagcgctcacttatccgctgccgggtcctgcacctcacccgcctgcgagtcccgcgaatccgcaggcgaatcagtcatcgaatccgctgcctgagagccaatcgaatcccggctctcccctactgcagactgcgacttaaccgtagcatgctgcgcgttcttgcgtgcggattcgagcgtcaggttctcggcttggatctcgggaatacgatgccgcagataggggtacatcgtggctatggtcagcaccaccacggcgatgggcatgcccacggccacatgctgcgctttgaagaacagaatcgtcagcgaaccgaatgcgatcagcgcggcccatccccacaggatcagcacggcgccacgcaccgaatgcccgatcttcagcatgcgatggtgcaggtgcatacggtccggatgcatgggcgactggcctttggccaaacgccgcacgatcgccagacacatgtcgagcacaggcaggaacaacaccagaatcggcagcagaattggcatgaacaccggcagatagatgctggcatgaatcgaggccgggtcaagacgtccggtcatcacaatcgaagcgcaggtgatgagatagccaagcagcatcgaaccggaatcacccataaacagtttggcgggatgccaattatgcagcaggaagcccacgcagatacccaccatcatcacgtcgatcagcgtggccaacgaagcataactcggggaagaccgggcgatgatatacgaataggcggcgaacgctatgccaccaatcgccacgataccggccgccaggccatcgaggccatcaacgaaattgaccgcgttaatcgaggcgacaatcaggaatgcggtgatcgccatggacagactcggcgaggcggtaatcagcgaaccgcccaaaggcagtgagatgatctgcaatccgccccaagccacgaatacggaaatcagcagctgaccggcaagtttcagcatccaatcgagatcccacaggtcatcggccatgcccagcagactgatcatgatgccgccggcaagaatcacccacatctggtaattgccgttgaacaatcccgagagaaaaggcagccgactggcgaatacggtagccacggcaaaaccgatcagcatgccaaggccacccatgcgcggcgtgggaatggtgtgcacgtctcgggcacgcacctcgccaaccgcaccgatttcgatggcgacgtggcgaatcagcggagtcaccagccaggtgacgccaccggcgatggcggcaatcagtaggtagattctcatgcgccgagtccaccgccgttgaggtggagggccttgcgaatcacgttttgggcgatgacgccttcacgcaggatctcgatgccgtcgcgcgcgtacggatcggctttgacgacggtgctggagacatggccttgggtgggaccgccgtccagatacaggtcgacttcgctgccgaacgcgtcaaccgcctcctggacggtctgcgcgctttcgtcgccggaacggttggcgctggacgcggccagcgggccagtcgccttgagaatcgcgaggcacagcgccgaattggggatgcggatgccttgcgtgccggggcgaccatcggcggtgtcggccaaagtctccaacgtgcagtcgggccgggctacggcaatcggcgagaacgcgccaggcagaaacgccgccgacaaacgattcagcggggacggcaggtcgagaccgagctcatcaagctggtcggtggatgcgagcagtacctgcaacgccttatagcgcgggcgacgcttgagccggtagatacggtcgatagcggccttattacgcggatcgcacgccactccatataccgtatccgttggaatgacgaccaatccaccatcccggatgacacgcgccgcctgtgccagcgattcatccgtgactttcagcgttgttccgccttccacgctcacgccacctccgttcgcttgtgtattcacaatctaccattgcaccattgcgccccgacttgcatagttcatcatcgctcgtttgccgtactgccgttttccgattcgccccacacgcacagaccgtagatacaatgagtccatccatgctctttcgcgaaattacaggagtgttcaatgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgaggcaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggcaatccggcccatccgattcgcgagattacggataaggatgcttccgcgctacagtattacgcgcagtgatatatgaatgctcccgctggcgagctgtcagcggagctgactgagggtggttgccggaaatctccgataactaccctcagcctcacttcgtgaggtagctcccgccggcggaagcatagtaatgtgagacgtcacgcgccgaggtacgccttgcgcaccttctcgtcgtgcagcaggtcggaggccttgccctccatggtgatcttgccggtctcgagcacgtaggcgcgatccgcgatggacagggccatcttcgcgttctgctccacgagcagcacggtgatgccacgcttgcgcagcgtgacgatgatgtcgaagatctccttgaccagcagcggggacagacccatcgacggctcatccatgaggatggtcttcggatggctcatcagggcgcggcccatggccaccatctgctgctcaccgccggaaagcgtgccggccagctggcggcgacgttccttcaaacgcgggaagtagtcgaacaccatctcaagatccttgcccagactggactggtctttgagactgaacgcgcccatctctaggttctcctgcacgctcatgcgggtgaacacgtggcggccttccggcacatgggccatgcccagcgtgacgatcttgttcgcatgcgttttgagcagatcgtggccatcataggtaatgctgccggatttggccggcaccagaccggtgatggtgtgcagggtggtggtcttgccggcgccgttggctccgatcagggagacgatctcgccgtcgttcaccttgaggctaatgcccttgaccgcgtcaatcgcaccataggaaacgcatagatccttgatttccagcatcagcgcgctccttccatcagtgtcttggcaatgcttggctccggttccgccttggtggtggaatcgccgtccgcgtcatcgttgttgtcgctgcccaagtaggcggagatgacctgcgggttgttggcgatctcctccggcgtgccggatgcgatggtgcggccatagtccagcacctggatgcgctggcatacgctcatcaccaggctcatgtcatgttcgatgagcaggatggcgataccgaaacggtcgcggatcgtgttgatacagtgcagcagatcctcggtttcggtggggttcatgccggcggccggctcgtcgagcagcagcagtttcatgccggtggccagggcgcgtgcgatctcgagcttgcgctgctggccgtacggcaggttggccgcctgggtggtggccagtccctcgaggttgaagatgcgcagcaagtcgatggccttctcgtgcatctcgttctcctgcttccagaagcccggggtgcggaagatggcgctgcccatgtggtaggtgaacgactcatcgaaggcgacgagcacgttctcctcgacggtgagctgcttgaacaggcggatgttctggaaggttcgggcgatgccggcacgcacgacctgataggtcttcttgccgttcatccgggttccgtccagccagaactcgccttcggtgggcttgtacacgccggtcagcaggttgaacaccgtggtcttgccggcgccgttggggccgatcaggccaatgagttcgcccttgttgatggtcatgttgaagttggacacggctttcagaccaccgaaggtgatgccgagatgttcggctttgaggatgggctgggttgcgtcgctcatcgtgaggcctccttcacggtcttgtcgtcggactggtcatgctgcttggcgctggccgcgggtttcgcgcccttgccggcggcgccgcggaacagcatgcggttgaccagacgcggcagtgagaactcccaggatccgaagatgccctgcgggcggaagatcatgacgagcaccagcaccaccgagtaggcgagcatacggtagtcggcgaaggcgcgcagcagctcgggcaggatggtcaggccgatggcggagacgatcgagccggtgagcgaacccatgccgccgaacaccaccatgatcacgtagttgatggagttgagccaaccggccatggtggggttgagcgagccgatgtactgggcgaagataccgccggcgatgcccgcgaagaacgcggagatcgcgaagacgagcaccttgaggtacgtggtgttgagtccggaggcgccggcggcgatctcgtcgtcgcggatggccttgaccgcacggccgtaacgggagcggccgaacatgaagagcacgaccacggtgaccaccatgatccagaacacgacgtacaggttggcggtgcgttcgatgccgatcagcgcctgtccggcggcgcccttgtcgaggcccatgccgccggctaccttgaggttctggatgatcacgcggatgatctcaccgaagcccagcgtgatgatggccaggtagtcgccgtgcagtcgcagggcaggaatgccgatcaggatgccgaacacgcaggccaccacgccgccgatcagcgtggtgagcaggaagcgggcggtggggtcgatggcaatgccggcggcgaccatgtatttggaggtcagtgcggccacgtaggcgccgatggcctcgaaaccgcagcatcccagcgtcagctggccgagcacgccgatggtgaggttcagggaggtggtcatgatgatggcgatgcacgcggtcatcatgatgcccttgatgtaggagtcggccaagccggattcgcacagcgccatcacgatgccgaacgcggcgaggatgccgatgaagcacacaagataggactgtttggtggaaagcattgtcttcttcatctgatcagaccttctccccttcgttcttgcccataatgccggacggtttgacgagcagcacgatgatcaggatggcgaacacgatggcgtcggagaacgccgaggtgatgatgcccgccgtgatggtgccgatatacgccttggtcaggctttcgatcagaccgatggccagaccaccgatcatggcgcccgggatggaaccaatgccgccgagcacggcggcgacgaacgccttcaggcccagcatggcgcccatcataggcgagacctgcgggtaggcggcgcagtacatcagcgaggcgaccgcggccagaccggagccgatggcgaatgtcagggcgatggtggagttcacgttgatacccatgagcacggcggcctccttgtcttcggagacggcgcgcatggccttgccctgcctggtgaatttgacgaacagctgcaggcccaccatgatgaccaggccgatgacgatggtcagcagggtgtctcccggcagcttgagcttgccgaacgcgatggacggcaggtggaagatggtcgggacggtctggaagtcggcgccgaagatggcctgtgagccgttctccagcagcaacgacatggcgatggcggtgatcagggcggtcatggagttgcccttttcacgcaccggcttataggcggccttttcgacgatcacgccgacggccacgcataccaggatggcgggaatgaccgccacccaggcgggcagtcccatggccacgatggccggaatggtgagcatgagcacgtaggctccgaccatgatgaaatcgccgtgggcaaagttgatcagtcggatgatgccgtagaccatggtgtagcccaatgccaccagcgcgtacacgctgccgattttcagaccgttgaacagctggctgatgaacatgatgatctgatcggtcatagctccccctttctatcaatgttgtggttctctaccgctgcgcgcgtagagatattcgtatgtcttgcgattgatggcgcgatacgcccgcgcctggcgatatccgcatatcgacggctgtccttatgcatccgagcccatgaaaacacgaaagggagaggaccggcaaaaccggtcgctctcctgttcatgcggaagtcatgctaggacatcgtgattatgcggtgggaattcatggaattcacttgggctgcacggtggtgttgtacaccggcttgccgtccttcatttccagcacggtcacggacttggtcggcgagccggacttgtccatggtgaacttgccggtcacaccgtcgaaggtcatgccggccacggcgttgcgcacatcctcacgggtggcgttctcgccagccttctcgatggcctgcttgatcatgtagatggtgtcgtagcccagagcggcgaacgtgttcggctcggcgttgttcttggacttgtaggacttgatgaagtcctgcaccttggtgttggtgttgtcgtcggcggagtagtgggtggtgtagtaggtcttgttgtactgggacttgtcaccggtgagcttgaggccatcgtatccgtcgggtcccatcacgtagccctcgaaacccacggagcgggcctgcgggatgatgtacgggccagccacggagtagtagtacggagcgtagagcagctcggcgccggaagcctggatcttctgcagctgggcggagtactcggtgtcgtcggcggaggaggagctttccttgtccaccacttcgaggccgagcttttcggcggccttggcgaaggcctctcccacgccggaggagtacggatcgccggtgccgtagagcacggccaccttcttgaccttcaggttctcggcggcgaagcgtgcagccacctcaccctggtaggagtccttgaagcaggtgcggaacaggtaattgccggtttcgatggagtcggaggtggcggccggggcgatggtgaccagcttggactggtcggccagcggggccacggctgcggtggtggcggaaatggtcgggccggccacggcgagcacgttgttgtcgccggcgagcttgttgtaggcgttggaggcttcggtggcgtcgcccttgtcgtccatggactcgagcttgaccttcttgccgttgatgccgcccttggcgttgatctcggagaccgccagctcgaagcccttgacctcggcctcgccgtaagcggcggcggtaccggagttggtggtcacggtgccgatggtgatggagtcgccggaggccttggcactggagctggaggaatcatccatgctgccgccggagcagcccgcgagggacaacgccataacagcggccgcgctggccgcaacgaacttagtggagaacttcacgttcatcctcttccttcttccttgggatatttcaacatcgttcatctgtcaaccaacgcgcgggatgtgcgcgtgagacgttccactcacataattcgcataccacagaactacatcacacggcttgtgaccgtcattcacgtctctctcatccgatgtttgtcgcggactgttataaccagaccggctttgaacccgcaataaattgttcttattatgagacagcgcaattacggaaacgagaatacaatcccaaggaaatgtgggattcgtggggcttaggacactgcaaacaggtagcggtcgcgacccgtccagtcctggccggtcgatgcggcagcgaatccggtggccctggcaaaggccacgagacgatccccctgggtcacgtcatgttccatgacaagcacgcccccaggcttgagaagacggcaggcccgctcgataatgcgctcgggaatcaacgtaccgtccatcgagccgccatacaaagccaattccggatcccaatcacgcacttccggctgctcgggaatatcggtctgcggcacgtaggggggattggtgatgacgatatcgacggtgccgtccaattgggccaatgtggcgaaggacgtggcatccgcgatttccagatggtaattcgaggcaatggatgggtactttttcgcggtttccgacagattccttcgcgtccattcggcggtgttcggcgacagctccaccgcccacacctggctgccgggcacctcgctgacaacggacagcccaatcgcgccggagccggcgcacaaatcgaccacacaaggatggatcatgccgttttttgtcagccagtcaaggccggcctgcaccacggtttcggtttccggacgaggaatgaacactccgggaccgaccttcaggtcaaggtagcggaaaggagcatgcccggtgatgtattgcagcggctcgcgcttggcacggcggtcgagcatggcacggaagacggcaagctgtccggttgtgccaagttcctcccccataagcagagccctgtcgacgtcgcgcagttcaacgcctgccgcctcggcaaggagcaacttggcatcatgctcaggcgtctcaatacccgcttcgcgcaattgcgaagaggcttggttgatgatgtcggtaataagcactggcggtctccgttgatcggacattaggctcccctcagtcagcttcgctgacagctcccctcacagaggggagccatccggcaaagtcatttctgattggccagacggtcggcctcgtcggcttggatgtcggaatcgatgacggcctgcaggtcgccgtcgagcacggcgtcaaggttgtaagccttgtaattcgtgcgatggtcgacgatacggttttccgggaagttgtatgtgcggattcgctcggagcgatcaagcgaacgtacctgcgagtgacgcatgtcggcggcctcggcggcctcctgctcatgcttcatggccagcaggcgggacttcagtacgcgcaacgcggcggcacggttctgaatctgcgacttctcatcctgcatgttcaccgtgattccggttggcaggtgggtcatgcgcacggcggaatacgtggtgttcacggactggccgccggggccggagctcatgaagatgtcgattttcaggtctttcggatcgatctcgatctcgtcgtcatcctcgtcggcctcggggaacacgatgacgccggcagcggaagtctggatacggccctgcgattcggtgacggggatgcgctgcacacggtgtacgccgccctcgtacttcatcgaagcccacacgccgtcttcgggagcgggcgtgcccttggcgcggatggcgatctgcacgtccttgacgccgccgagctcggtggtgttctcggactgcacgttcacgctccagccacgcttctcggcgtaacgggtgtacatgcgcagcaggtcgccggcgaacagtgcggcttcctcgccgccggtgccggccttgatctccatgatggtgtcgcgcgcatcatccgggtcacgcgggatcagcgcggtgcgcagcttctcctcgacaccgggcagttcgtcttcaagacgcttggcttcctcggcgaagtcggcgtcctcgccggccatctcctgagcggctgccagatcgtccttcacctgcaaccaggctttgtaggcacccacgatggcacccagttcggcgtgacgacgacccagcttgcgcagcttgtccgggttggacacgacttcggggcttgccatctgttcttcgatggactggtactcctcaagcgcggttgccgccgccgggaactgttcgtctgccataacacactttcttctgtatggtgctgttctgttcgattattcgattgcgcaggtcaatgctgcaacaaaacttgtcaaagaatacaaaaaacgccagtcctcgatcgggtatgccggagcatgccaaatcgaatcggactggcgtgaagtatgctacttgctcttcttgccgtagcgcttctcgaagcgagcaacgcggccaccggtgtcaagaatcttctgcttgccggtgtagaacgggtggcactgagagcacacgtcaacgaacatgtgatcttccttgccagcggtgcgggtcacgaaggtgttgccgcacgagcacgtcacctcaacggggtgataatcaggatggataccctgctgcattttacgtctcctatggattcgggggacccgggtcgtcatgcccctatggcaagacgtgaaccggaacctaagggattgtacacgcctatctggacgtgaagacgcgctgcgccgccgcaggagacgacgcaaaagagtggggccgcaggggcttgaaccctggaccgggcgattatgagtcgcatgctctaaccgactgagctacggccccacgttcgctgcgtaaaacagccaacttgccaaagtgtagcacgagcccgctaatgccggcacgcgcgccatgcacccataccatgcacccgccagcaacaagcagcatctcccggcgctacttctcccccatgtaccccaacgggttctcgatgaaccgtcgcaagcccatttcggccgcgccatatagcgagggatgcagcgccaccggcggcacaaacacgcgaatcttcacattcgggtatcccagaatttccgaacgcagccggccttcaagcacggtggccagctcgtcgccgaagtgcgtccacagtccgcccaacagcaccgtatcgacatccaccagattcacggcggaagcgatggcggaaaccagcgcatcggcggcctgatcgaccactttggccacatccgaatccccggctcgccaacgctggaggaacatatcgatggcctcgctgctggtggcatccccatcctcggcaatgccggcagcctcgaccaaagcgcgacggcccgcaaacgcctcaagacacccgtgacgcccgcagctgcacaacggcccatccatcgccacggacagatggccgatctcgccggcgaatccgtgcgagcccatcaccacttcgccgtcgcgcaccaccgcgccgccgatgccgatatcggtagacaggtaaataaaggagtccgtgcggtccaccacattcaggaagggcgcacgttcggtggcataccccggaatctgagcgatggcggccatcttcgcctcattgccggccaccacatccagccggcgcaccacgttgaaccgggtgaggttgacgttttcccaacccagattgcgggccaccaacagccacatgtcgtcggtgacgatgcccggcagcgcaaacccggctcccaccaccttgcagccgcgtcgtttgagccggctttccaacgggaaagtcatcgcatcgagcttggcgaagatctcgtacgggtcagtgccggtcatatcctcactcacccactcccggccgagagtgtcgccgttcagatcgagtgccaggcaaccgtaaccatcggtgttgatctgcaggccgatgccggcgatggatccgccgcgaatctccagcggcgtgctgggccgcccatatgtggtggaaacgaccggctcgccttcctgcaccacgccgctttcaatgagcatcgaggccaacagcgagagcgtggccttggtcaggcccgtctccttggccagatcggcacgactcatcggtttctgcgcacgcaataaggtgtcgagcgtcaccgacaggttatggttgcgcagatcctcctgattgatcctgcgtagatttgccattggcccctacctcctcgcacccctagtctcgagcgccgcacaggcgctcacatccgtctatcacaccatgatattgtgcgtcaaacgattgaatcggaccgcaccttcgcgtgtttccgtttgcaatcgaacgttgagatacagtatagtttaatcgtctaacttattggctatggcgcgccgaaacttttgagcgcgaccctcatcgaggaggaatgcatgacgagagtactggttgccggcgtagatacgtcaacccaatcaacgaaggtccgcatcacggacgccgccaccggcgaacaggttcggttcgggcaggccaagcacccggatggcacctcggtcaacccggaattctggtgggaggccttcaccaaggccgccgagcaggccggcgggcttgacgatgtcgcggccctcgcggttggcggccagcagcatggcatggtcattctcgacaagcagggcaacgtgattcgcgatgcgatgctctggaatgacaccagttccgccccgcaggccgccgccttgatcgacaagctcggtgcagctccggccgagggcgacgaaccggacgacgtgaccgcccgcggcaagcaacgctgggtcaaggccgtcggatcctcccccgtcgcctcctacacgctgaccaaggtggcgtgggtggccgagaacgagcctgagaacgccaagaagattgccgccgtctgtctgccgcacgattggctgagctggcgtatcgccggctatggcccggtggccgagggcgaggacgctcatctcgaagccctgttcaccgaccgttccgacgcttccggcaccatttactacgatgccgcgcatgacgagtaccgccgcgatctcatcgccatggttctggcccctgccgagggcgaggaagccgccaaggcccacgccgacgccattgtgctgcccaccgtgctgggcccgcgtgaggcagccgccgtcaaggccgaccccgccattgccggcaaggacgttgaaggcggctgcatcatcggccccggcggcggagacaatgccatggcctcgctgggcctcggcatggccgtgggcgatgtgtccgtatcgctcggcacttccggcgtggccgcggccatcgctgaaaacccggtgtacgacctgaccggcgccatttccggctttgccgactgcaccggccactatctgccgctcgcctgcaccatcaacggttcgcgcattctggacgccggtcgcgccgccctaggcgtggactacgacgaactggccgaactggccttcaaggccgagccgggtgccggcggcatcaccctggtgccgtacttcgacggcgagcgtacgccgaaccgtccggacgccaccgcctcgctgactggcctgaccctacacaacaccaccaaggagaatctggcccgtgcgttcgtcgaaggcctgctgtgttcccagcgcgactgcctcgagctgattcgctcgctgggcgccgagatcaaccgcatcctgctcattggtggcggcgcgaagtccgtggccatccgcacgctggccccctcaatcctcggcatggacgtgacccgtccggccaccgacgaatacgtggccatcggcgccgcccgtcaggccgcctgggtgctgtccggcgaggccgaaccgccgacctggcagctcaccatcgagggcgtggagaccggcgagcccaccgaagccgtgtacgaggcgtacgccaaggcccgcggctgatacgctgccagcaaatccatgagataacaactgaataacgattcctgatgaatgccgccatggcgagcatcgcgaagagccgctgttataccgcgctcctcgctgaagcacacatggcggcatttttcgtttcccacgcaatccacaaatacggctataatcaagtcgtttgaacaagtctggagattcttctatgaacgaccgttcccgtatgatgctgtacgccctgaccgccgtcgcatgcgtgatttggatatggcaatccgccaaagaagcaatggccgatggcacgatgatcagcacctcaaacatcatctttttggtatgcatcggcattgccgccgtctactgcgccgccaacgcattgatattgtggtggcgtcaacccagcaaggaggatgcggagaacgatgacgccgcggatacgcctgacggtaccgataccgacaccgcagatgccgagggatccgaggacgacaccgatgacgatgtcgaaaccgacgtcgcaaccacggatgccgatgcatcaccaaccactaatcgccagtaaccatcgttatcgttcgcccgaatcaagcgaatcatcccacttcagcaaaggaacattatggaagtaacaaccgtgtcaaccgtgatcagcgtggtgctgggcgtcatatgcgcgccttgcggcctgtttctggggctcgttcccatgaaggccggcctggtgaccgccaagcagtcaaaggcctcgcagatggtgagcttcatcgttgccatagtgttcatcggcttgctggtcgcaggacatgatctggagacctgggccatggtaatcggtctggtcatcggcttcgccgttgccaagattcccgcgctgcatgcctgggctttgcacaagtggccgttcttcgagcccaagaaagcggctcccgctcccaagcgcgtcaagaaagccaagaagaagtaagctctggccttacctattcgctgaaagcgggatatcgacatcggtatcccgtttttcattggccgtacatatccgctgaggcacatcgccgaatcatattgtcgaaatacaccccaagtcagggctgatttcgcgaagaacgtacaccgggatccatccatcgcgacaaacggaaaagggacgctgcgtgcaacagcgtccctttcggaggaggaatggaactcaggtccatccccgtggccaccgggcgggcccggaggccaggtttagctcagcctttctttttcttggagagcaggtcgtaggcgacggcggcgatgacgacgaggcccttgatggtcttgacccaggcggcgtccacgcccatgatggacaggccctggttgagcacgcccatgatcagggcgccgaccatggcgccggggatggtgccgatgccgccggtgacggccgtgccgccgatgaagcaggccgcgatggcgtccatctcgaactcatgccgggcctgtctcgttaagtgtgtaactggcgttttcattgttgtgttccctcgcttggccagcggtcggcgaaggtgatggcaaaggcgttgagcgcgggcttccggcgcgcgctccatcgtatccgtcccttgccggtggggtccagcgagcggacggtcaggtacatgcacttgagcgcggcctgctcgtcggggaagtggccgcgggcgcggatggagcgcttgaatctcgcgttgagcgattcgatggcgttggtcgtgcagatcacgcgccggatctccacgtcatagtccaggaacggtatgaaccgttcccacgcgtccatccacagcctgcggatcgcgggatatctcgcctcccacttgtccagcatcgcgtcgcgggccgccgccgcggcggcggcgctcggcgcggtgtagatgggtttgacatcgcgtttgatggcgtcccagtccttcttcgacgcgtagcggaacgtgttgcgcagcagatgcaccacgcaggtctgcacgatggccagaggccataccgcgcccaccgcgtcgggcaggcctttgagcccgtcgcagatcaggaagaacacatcgtccacgccccggttcttcagctcggtgagcaccgacagccaatagcgtgcgccctccgcggcgggcgacgcccagatgcccagcacgtcgcggccgccctccagatccacgccaacggccacgtagaacgcgcggttggcgacctgcccgtcgcgcaccttgacgacggtcgcgtcgatgaacacggccgcgtacacacgatccaggggacgcgagcaccattcgtccttctcggccacgacccgctcggtgatgcgactgacggtctccctggacacgtccgccccgtagatctcctggaagtgggcgctgatctcgccggtggtcaggcccctggcatacagggacagcaccacctcgcccaccccgggcagccgccgctgccgtttcctgacgacgaccggctcgaacgagccatcgcggtctcgcggcacctcgatcctgaccggacctaccgaatcggtgaccacggtcttggcggtggtgccgttgcgcgtgttcgcggccctgccgtccttggatttcttgtgcttggcgcggcccaggtgctcggtcatctcctcgtccagggccgtctccagcacgcttttggtgaactgtttgagcagtccccgtcgggccctgtcaggtccagtcctttttccttggccatgcgcacgaatgtgagcgccgcctcccgctcggcgttgcgtttttccgcgtccggcttcttcgtcggtgtcatgtttccccttgtcccagcagacatcgtccaccagcctttccgaccggccacacgaccggccagttaaggccagttacacacttcgagagacagtcccgttttcagcggaaggagagaaaggagaaagaaggaatggaaaggtgccatgcgggcataacacaacaccgcacatggcgaaactatcgaatcagcccatcgggcgcactggcatcataattgatgtgtacgcgcccgatggagcgaattcaatcggtcagaccgatggtcactcgacctcagacagggcatcaatgatgtagttgttgatcgtggccttgacggactcgaggtgatcggacttggtggcggcgatgagctcggactgcggcttgtcgaggctgtaggcttcgaggtcggccagggtcacgttgccctcgtcgatgtccttgccgatgccggaatcgtaggagctgtagcgctcggccatgaggtcctggatgaagccgtcctggttcatcttgtcggcaaccagcaggccggcggcgtaggtgtccatgccggcgatgtgggagcggaacaggtcctcctcgtagaaggaggtacggcgcggcttggcgtcgaagttcagaccaccgtgaggtccgatggagccggcctgcaggacttcccacatgacggcgacggtctcgtacaggtcggtcgggaactcatccatgtcccagccgatgagcttgtcgccctggttggcgtcgagggagccgaggaagccggattcgcgggccacgcggatctcgtgctggtaggtgtggccggccaggttggcgtggttgccttccaggttcagcttgaagacgtcggtcaggtcgtggttgcgcaggaactcgatggcggtggcggcatcgaagtcgtactggtgcagcgtcggctccttcggcttcggttcgatcaggaactgggcctcaaagccgatttccttggcgtagtcggcgcacatgtggaagaacttggcgatgtggtcggtctcgcgcttcatctcggtgttccacaggttctcgtagccttcgcgaccgccccagaacacgtagttctcggcgcccaggcgcttgccgatctccaggctcttcttgagctggccaccggcgtaggcgtagatgtcggcgaacggggaggtggcggcgccggacacgaagcgcgggttggtgaacagggaggaggtgttccacagcagcttgacgccggtggacttcatgttctcctcgatcttgtcgacgaccttgtcgaggttggcgttggtctcgcgcagggtgtcgccttcgggggcgatgtcacgatcgtggaagcagaagtactcgacgcccagcttctggaacagctcgaaggcgtagtcgaccttggccagagcctggtccatcggatcggtgtacttgtagtacgggcggtgcgcggtgccggtgccgaacggatcaaccagttcctggttgaaggtgtgccaccaagcgacgccgaagcgcagccaatccttcatcttcttgccggcaacgaccttgtcggcatcgtagtaatggaaggcgaagtcttccttcggccccttggcgcggccgacgtactcgatcttgtcaacatcccacagacccatttgggcgctcctttgcagtaggcgatattacggattgcaggactaataataaaacgaacaaactaagtttgtcaaatgattgaattaatacgccgcctctcagcgtgttgctagccattgcaatggttttcgaatgcagtcaaggcacaagatagtatgggcaagccaagaaaacgaggctcgataattgacgtcacgcaattcctcgccggccaccgctgaggccggctccaccacccccgccaactccaacagcaccacccctgccaacaccactgccatggtcatcaccctgatgatcggctcgtttgtggccattctcaaccagacgctgacgatctccgcactgcccacgttgatgcatgaattcgatgtgcccagcagcaccgtgcaatggctgaccatcggattcatgctcaccaacggcatcatgatcccgatcaccgcgttcctcatcgagaccttcaccacgcgccagctgttcctgtacgcgatgggcatatttgcagaatgatcttggcgttaatgcactggtgtccggtctggtgatgatgccgagcgacatcgccatgggcatcctgaacccggtggcaggcaagatgtatgaccgtatcggtggccggccgctcgccttgctgggcttcgcgatcatgacgtttgcggctgtgctgctggtcaccatcatgaacacgcacaccgcggcggccatgcgaaccggagtgccggaagcggcggcatcggccattggagtgcgggcttcgttccgcacggtcgccattgtgtgcgcggtctgtttggtcgcatccctcttcattcgcgaccgtggacgtcgccccggccagcagcgttaagcgattcattcatcgatcgtaggctttcctgatgatctcatccgacgtgccagcgttacgcgccttttccatatcctcccagtcgagaccggtgtctttggctcgcccgtagaagaatcgcacgagccccgcgaaatccggcttaaacccgttgcgctgaaatgtgcgaaccagcgaatcaccgatttctgggtcgtcgggcctgcgtgcctcataaatcgggatggcgcatgacctccatgctcctcgaacatgcgcaatgcgattgacgatcatgccaccgtgcgcaccgtcatattgcgcggcggcatgcgggtccgccacctcgtaggtgccaccgtggatcatgtcttcgagtatgatgcgccccgtgaccgcgctggcatcacgaatccagaacatcgacgcgaaattggtgtcgtcaagttcgcgaaaatcacgtatttcacgtgcgccaatccacgagtcactgtcatgcatgaattcagccaaagccagaaacggtgaaatgcctacgcttgggccatattccagttcgatgcgtagatcctcggattcgtcgccggtcagtcccacgccgctgacggcgcagtcataggcaaaccaatcccagaaccaccattcgatcctttgcagtacctgcttcggatactttttgcatgggttcagattcacttcgcgataatatatgcgtctcgcttcggcatagacggcgagattgcagcgtttgaacatctcggctacgtctttggtgtccagcattgctggcaaaccggcattttcggcagtagtagtggttgcggtgctcatggtgtctccccttcatgtgatgtggacggcgggctacgttgcccgccgtgaggcacactgtatggcgctcatgcggtggcccgcaagcccacatggcgaaatggtggataagtggaaaacccaatgattccaaggggtatgaaatgtgcataacagtggataccgtcggtggataaccgcactttcttgcaggttatccactgatcgcgcagctgttatccaccgtctctgggttatccacatcgtctctggcgtgtcgtccactgtcagcagtcgatttctgcttcgtttggcgtgtataagtgcacggtgaagtgtatagctccgcgcatcaggcatatttgctactgagaaaggtcccgaaatcgccttcgaacgcatagctacactcagcagatgtattcagcatggcaatagacccacttaggcaccagcgaatgattttcccccgcttatagagtcggcaaaggcccaacacctgtcccaacgccgacgctactgcactggcagcgtcggcagaggcccacaacttggcacagcaacgacgctaaaaccgcccagcatcgttacacgtccaagttttggccgctaacgacgcttaatgaacgcttagcgtcggcagcaggtcacgcactggttctccaccgacggtagcgctccttagcgaagccagcccgccactctttggcacatcaccgacgctgagagaacctccagcgaagccaaccagccaaccgctggcaacatgacaccacccacacccctcagcgaagccaacctgccagcgcatggcaccccaacaccgatgagaacacccaccccaccagtgcacaaaaaggctggtcatagcggttgcgatgtaatcgcatcgtaatcgcgatgaccagcctcgggagttgggctgcaatgagcaccgatatgaatcagataatgatgccgttgcagtgatcgacttcatgctggataatctgcgcagtccaaccggcgaaggtggcgtggcgggcgcggaaccgacggtcctcgtagttgacctcaatacgtcgataacgcagcgtgcggcgttcaccggtcagcgacaaacagccttcctgggcgtcgaaggcaccatccgaagcggtgatcacggggttgagcatcaccgtgatacggccaccgagatcttcgtccacgaagacgatgatgcgcttgctcacgccgatcatgttggcggccatgcccacgcaccgtgaacggttggcctccagcgtgtctacgaggtcttcgatcacctgctcgtcgccgggcccggccgcttcggacggcgtgcgcaaaaacgaccgcgaagtcataataggacgttgcatgctggaatcacgcttcttcgtgccaatgggggttctggccgaaggtgtgaccttcggggttgtccattgcggcgatatcggccatgtcctgatcatcgagttcaaaagcggtcaggtcgaggttctgacgctggcgctccgggttcaaggacttcgggatggccacgtcgccgtactggaggtgccagcgcaaaatggcctggaccacggaaataccgtgcttggcggcgatacgcttcaggtccgggtcgcgcagcatctggttggcgcggcccagcgggctccatgcctcggtgatgatgccgtgcgcgttgtcgtaggccagctgttcgcgctgctggaagtacgggtgcagctcaacttggttgacggccggggtcacgcccgtatcgcgaatgagcagatcaatatggccgggcaagaagttgctgacgccgatatgcttgaccagcccacgttcacgggcttcgaccagcgcctcccatgcctcaacgaactggccttggctcgggttcggccagtggatcagatagagatcgatgtagtcgaggcccatacggcacacgctctcctcaatggtgagcagcgcctcgtcatgggcgtggtggcggccgggcagcttggacgtgacgatgatgtcttcgcgcggcacaccggattcgcggatagcgcggcccaccacgccttcattctcatagttgaaggcggaatcgatgagtcggtagccctgatgaatggcggacttgatggcgtccacgccggccaggccgttgaccttgtaggtgccgaatccggtggctggcagttcgaggccgtcgttggccttgcggatcggagtgaccggtggttcaagcatgatagttctcctgcttctcctgtgatggcatatctgttccatcataaagccaaccaatccgctgcgggcatactatttgacttccctcatttccggcgggcggcgagtggagaatcggaacatgagcgaggcgaggatcacgccgagcacggccatgccggcgaacaccatcatgctgcgtgggaaggcgatcatatacgaaccggcggcgtctgccccatcgttcgcggcgatggccaccacccacacattgccggacagcgtcacgaacaccgcgtccatgattacggtgcccgcgaagccgatgatgatgaacttgggcgggaagtggctcttcagcacgccgccgaataccgggccgatggccggtgcagcgcaggtgaccagactgacgatgccgagcatcgagccgcgctgttcaagcggcgcttttccagaatgatgctggtgatgagcgacaaggagatgccggtgccgagcgacatgaccagtcgggcggcgagcagcatcgggaagttgaccgcgagcgcgcccagcagtgtgccggcggcgaagatcacgacggccatgatgaacagggttttggtggcgaacttgcgcaccatgaacggcgagctcggaatcgacaccgacagcaagagcagataaccggtgacaagccactgcaccaccgaggcgccgatggagaactcctccatcggcgtggagtaggcgatgttcagtgacgtttccgataggatgccgaggaaggtcaggatcgcgagcgagacgaccgcgatgacgagtttgttggagaccggttgcttgccgccgttaggcagctgtgttgcggaatgagtcacgatcttgttctctcctccattcattcagatattctgactacgacgttggaagtcttcctgcatgagtcgcagagcctcggtcaaggtgcgtaccgtggtttcgcactggtccgaggtcaatccgcccagcagttggctcaaatgcgcgtgatattcctccacatagatacggcggatatccaagccgcgttcggtgagcgtgagcgtcaccgcacgccgatcggcggcatcggcgtgtttgacgacgagtccgaggtcggccatttcgccgacgagcttggtgatgctcggcgtagtgacgccgaggaatgcgctgacgtcgcccacgcgcgcggtgccggtatcttgcccattcggttcgttgatatgccagacggcgtcgatcacgtggacatagcgcggtttcatacctttcggcaatgccggcatcagttcggtgatggtcttggccttccagcagacatccaggaggctccgcacctcattcaccggaagcaagccggtcttggtatcggttcgggaatcgcacatcgctggcccaacctccaattagttaccaatagtcattaccataagtaactatatgcaggctctagacaaacccaacggcctgcgcgcccgtgtcgagttccgtttcgacataaaaaagccagggaatccctggcttgcaatgcacatatcgctgcagatttgccgggacctatatgtccccggcaacaacagccgtatatacgctaccgatcagtgctgccctcatcatccttggcacctgccgtggcggcctcagtctccttggcgttccacccggcgacggcattccaaccactccatccgatgaccactagcaagcacagcgagaagacaatagtggcccaattgaacagcgagccatcgttattggcctcgaccagtgactgccagagccagataacgcaggccaagcaggtcaatgcatacatacgggaggtggagcgcgcggtgagtttcatggcggaaaaagtcctttgattacaagaatgacggcagataacagtgtgggatccgcaccagcggcaccggcacgaatcccacatcgaggaggagaaaggggaaggtcagctcttcttgcgcttggacatgatgtccacggcgacggccagcaggagcacgaggcccttgatggtcttcaccacggcggtgtcaacacccatgatcgacagaccctggttgataacacccatcacgaatgcaccgatcacagcgcccgggatggtaccaataccaccggtaacggccgtgccaccgatgaagcaggcggcgatggcgtccatctcgaactccataccggcctgagcagttgcggaagccagacgggagagcatgcagacagcggccactgcggacaggaagcccatgtggacgaacagcaggaagtccacgcggcgggtgttgataccggagaggatggcggccttgcggttgccaccaacggcgtacacgtggcgaccgaacacggtcttggtcaggatgaagttgtagatgaagaccagcacaccgacgatcaccagcatgatcggggtaccaccctgatcagcgttaccggaggaagccagcaggtaggtgacgaaggcgatgacgaccgcggcaagcacaattttgaggacggtcaggctcatcggctcgggcaccaggccgaccttggccacacgggcgcgcttgcgcagctggctccaggcaaagccgacgatgcacaggatgccgagcacaatggtcagaccatcgaacggaccccaccagccaaggatgttgggcaggtagttacgggcaatgccacggaattcgagggaggtaatcggcacggattcgccgacgatcacggtggcgagaccacggaagatcaacatgccggccagagtggtaatgaagcccgggatgccgatgacggcgacccagaagccctgccagacgccgacgatcaggccgacgaccagagcgatgacgatggcgagcatccagttgactccggcgcgttccatcagcagtgcacacacaccaccgatgaaggctaccaaggaaccaaccgaaaggtcgatgtgggtggcgatgatgaccatcaccataccaatggccaggatgatcacgtaagcgttctgctgaatcagggacacgaaggagttcggcttcagcagcacgcctccggtcaggacctcgaaggccacgacgatgaccagcagtgcgccgacaataccgtattgacgggcattgttggcaaccgtggccagcaggccggtcttttcttctttctttgcaggtgttgcagttgcggcgctcatcaggctgccacctccctttccttggtcatacccttcatcaggtattcctgggtaaatccattcttctcaacattgtcggtgacgacaccgtaggacaccgtgtaaatgcggtcacagataccgatgagctcgggcagctcggaggaaatcacgatgacggccttgcctgcatcggcaagcttatcgatgatttcgtagatctcatacttggcgccgacgtcgatgcctcgggtcggctcatcgaggatgaggatgtccggctgcgagataacccacttggcgagcagcactttctgctggttaccaccggagagggtggagacattcacatcgatgtcatggcacttgatgttgaagtccttgcggtactgttcaacttccttgcgctcaaggttgtcgtccacaaccccgcccttgctgatcttggtcagggaggccagggacgcgttctctcggatgttctgcagcaggttcagaccgttgcccttacgatcctcggtggcgtaggcgagacctgcgtcaatcgcggactgcacgttgggcatcttgacttccttgcccttgacgaacaccttgccggagatgttggaaccgtaagagtggccgaagatggacatggccatctcggtacgacccgcacccatcagacctgccagaccgacgatctcgccggcatgcacgttgatgttcgcatggtctacgatcacgcgctccgcgtcgagcggatgatgcacggtccaatcctcgacacgcaggtattcctcgcccggggtattggaggggtggttcgggtacaggttgtgcagcggacgacccaccatcttgcggatgagttcttcctggtcgagcggcgtctccggcgtcacgtacatcacaccgacggtcgaaccgtctcgaatgatggtgacattgtcggcgatggcggcgacctcgttgagtttatgagtgatgatgatgctggtcacgccctgctcgtcacgtagctgacgaaccaggtcaagcaggtgggcggaatcctcatcgttcagtgcagcggtcggctcatcgaggatgagcagcttcacgtccttggacaatgccttggcgatttcgacgagctgctgcttgccgacgccgatgtccataaccttggtatccgggtcttcgggaagtcccacacgatcgagcagcttcttcgcctcggcacgggtcttgtcccagtcgatcacgccacccttggcctgctcgttgccgatgaagatgttctccgcaatggacaggaacgggctcaacgccagttcctgatgaatgattacgatgccgtcggcctcggaatcattaatagtatggtatttgcattccttgccatcaaaggtgattttgccggaatagctaccgtatgggtacacacccgaaagcacgttcatcagggtcgatttgcctgcaccgttctcgccgcagatggcgtggatctcgccgcgatcgacggaaagattcacatcggtgagggctttgaccggaccgaacgtcttcgtgatgttttccatcgtcaagatggtgtcatttgatgacatgtcaccactcctcgtcacagttctgtgttcatggacatgcggcgcatatcggctatgcgccgcatgtcattgtgtttgtttacggattgcctgatgaggactacttagtcagctcgtcgaagcgatcctgggtgatgtagttggccgtgaccagatcctggaggttgtccttggtgatgttctggggatcaagcagcttggacgggacgtcgatgttgttgttgttgaacttgccgttcaggccggagacttccttgccctcggcgatctcgacgaccatgtcgtacacggcgtcagccagcttgttcacgtccttgaacacggtctcgccctgcttatccttggcgatgttggcaactgcgatctccatggcgtcctgaccggtgatgtacggccaggagtcggtgcccggcttcatgtcgggacgcttggattcgatggcgttgatcacaccctgggcgatgccgtcgtacggagtgaggaccgcgtcgagcttctcgccgtgggcgtaggtggagtcaaggatggattccatgtccttctgcgcctgctcggtcttccagctcatcacggagatcttctgccaatcctcaacggtgaagtccttggtcacgccaccctgaccgtgctgggacggggagacgagcacgcccttctcgaagtacggctgcagcagatcccaagcgcccttgaagaagtacttggcgttgttgtcatccggggaaccggtgaacagctcgatattgaacgggccggtggcgccatccttaagcttgagctggtcaatgagccacgtggcctcgagcacgccgacctgctccagctggaaggtggcgtagtagtcgacggcgtcggtgttcatgatcagtcgatcataggcgatgaccttggcgcctgcatcgcgggccttctcaacggcggggcccactgcggtgccatccttggaggcgaccacgacgatcttggcgtcgttgttgaccatgttctcgatgtcagcgttctgctgggccggcttatcgtcggcgaaagacaggatgaccttgtatccggccttctccagcttggccttcaggttgttgccgtccttgttccaacgctcttcggacttggtcggcatcgaaatgccgatagtggcacccttttcgatcttggcatcaccgccagttgcctggccgctacggctgccaccacaggccgcgaggcccgcgcacatggcaacgcctgccaccacggcgacgatcttcttagtgaacttcatttgctctccttcatcttcgaggggatggcgaaccctccttggtcgcccgaacctgagaataaccttaggttcatctcatagaataccgtattaagttaagttgtcaaactcaagaaagcgaatttcccgtcgtttgcgttcgaccaatgaacgcaatggcgattttttcgcgcatcacaaggcgacacgccgaaaaatccacgctctgcgcctcgctgtgcctcatgccggtaacgactacactggattcttatggcaacaaggcttttcggttcgcagacctcgcttcgcgaggcaaaccgcgccaacttgctggccagcatccacaagttcggcgccatgacacaggtcgaactcgcagaggtgacaggactgtccactgcgaccgtgtccacgctcgtccatcagctcgtcgacgaagaccagctggagaccaaaagcaccgttcgcaacggtcgcagagccactctggtgacccttgcacggcatcagggcctcggcgtcgggctttggatcgcgcgacgtcatcttacgctttctatcgttgacttctcgaagtcaatcatcgctgagcacacgctccccctgccgttgggccacaaggcggacacaacgctggaacgcgccatgctgctcatcaatgagaccctgagcagcatcgacgccgaagccagcgagctggtcggcatcggcgtggccgtggccgcaccggtggccaccagcgaccacaccatagcgattcccggcattctgcccggatgggacggcgtcgatatcacgtccccgttgcgcacggcgttcaacgttcccgtatacgtcgataatgacgcgaatttcgcggcatacggcgaatcccgtatgggcgtggcggcaggcaaacgcaatttcgtatatatctcagccagcgacggggttggcgcaggcatcgtcatcaacggcgaaatcatgcatggcgtgaccggcctggccggtgaaatcggccatatccaggtcgacccgctgggtgccatctgttcgtgcggcaaccgcggctgccttgacaccgtcgtggcggaaaacaggctggtgcagttgctcagcgtcacacacggcaatatgacgctggatgatctggtgtcctttgccaacgaaggcgaccccggttgccgtcgcatcatcgccgacgcggccgtgcgtatcggtcaggtggcggctgatctgtgcatcagcgtggatccggaggtcattgtgctcggcggcaagctggccatgaccggcgacgtattcatccaaccgttcaatgaagcgttgcagcgcatgctgttccctgatgccgtggcacccatcgatgtactcgtgtcatcccacccggacgacaattgcgcgctaggcggcgcattatgcgccatcgagttctcggttcgcaatgacgtcagccagtgaccggtaccaggagaagagtgataagaaggaacacaccatgaggaattcgagcacacctcctctgctgcggctggaggacatctgtgtgaagttcggcttcgtcgaggcgttgaaatcggtgaatctgtccatccagcaccaggaggtcatcgccatcgtgggcgataacggcgcaggaaagtccactctgatcaaggtcatcgcgggatttctgcagccgggattcggccatatttatctcaacggcgaacaggtgaccattccctcgatcagggaggcggaccgcatgggcatcgcatcggtgttccaggggcaggagttctgcgacaacctggacgtggcctcgaacctgttcctcggcaaggagatcaatcagattggcatacgcgatgacgattcgatgaactcgcgtgcccgttccgtgctgaagaccctgagctcggcgattcgggtcggctcccctatcgcatccttatccgtcggccagcgccagaccgtggccatagcgcgcacgctgctcaatgacccgcagcttattctgctggacgaaccgaccgccgcactgtcggtgatgcagtcggcggaagtgctcgcatatatcaagcgactgcgctccgaaggccggtccgtggtgatggtctgccacgatctgccggatgtgttcgcggtatccgaccgcattgtcgtgatacgtcaggggcacgtcaccggcgtgcatcgaaccgtcgaaacgtcctatgaggagattatcgccgaaatcgccggcgtgaccaccgaacacgagtatgaggaaatcgccgagaacccgaaattcgattccatggtcaggcagcggaaactcatcgaccgcactatcagcgcggcagtgagccatggcaccggccatgactcaccattagactaacgccccgttgccggagcggcatcgtcagcgcagagccaggttggcggcaccgatgaggccggcgtcttggccggcggtggcggcgacgatcttggcatggccgcggtaggcgctgccttccaggaaacgctggtagttgtagcgggccggctccagcagaatgtcgccgacggccaccacaccgccgccgatcacaaacaggtccggatcgagcacggcggagactgcggccatcgtgcggccaagccattcgccgatcttgccgaatgcgtacaggccgagcacgtcgccttcctgggcggcctgggagaccatcgggccttccagcttggagatgtcgccgccacacagctccatgagacgcttggcatcctgcggacgacggcgcacggcggacttggcgaagttctccagcgaagtgcccgaggtgtagcgctcggcgcagccgcgcaggccgcagccgcagtggtcgccgtccgggaccatcggcaggtggccgagttcggcggccatgccgaaggagccgcgatacagctgaccgttgatcacgatggcgccgccgaggccggtgcccacggtcagggcgaccatgttggagctgccctggccggcaccgtgcacgtattcgccccagccggcgcagttggcgtcgttctcgacaacgaccggcacggcatggtcgatcagcgcgccgacgtgctcggacaggtcgtagttgatccaggccgggatgttggcggagaaggtgagcgtcttgcggtcggcgctcacgttgccggcggcggagatgccgatggcctcgatatcggtgtgtccggcggccacagcctcgcggtacacctcggcgatgtgctggttgatggcgtcggcatccatcggcgtggggacgcgccagcgctggatgatgctatcgttttcatcgcagacggcggcggcgatcttagttcctccgatatcaatggcgagcgtggtcatggcttactccttgaaggcttgtgtggcgtacgagacagcgaaaatagtaacgagttgccatgacctcccatagcgtatttttcatgatttgtcatatctcgcgcacgttctgccaatgtgaccctgcacacgtttttcaccattcataagcactgttaacgctaacgttgtcattcaatagcaaacgttgtcattcagactatcggcgtgtcgagcagagccccaaggccagcacgaaaccttcggtatttccatgcgatacggcatcggcatcgactgaaacagcttccatgccagagtcgaatggccatcaaacgactaaacaccagacacacattttggcctataacccctgtaaccccgccctacaccacgaaatacggcaaaagaacagaaaagctcctgacatttgtcaggagcttggtggcgaccccggccggacttgaaccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtgattcggggggcgtgctccgcgctgcacacagcgtatccatcacaaactaaagactaaagaaacagcggaattccaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctcccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgtgtgctcatcgacgacctgtccttcacgctgccgcgcaacggcatcgtcggcgtaatcggcccgaacggcgtgggtaagtccacgctgttcaagaccatcgtgggcctggagccgctgaccagcggcgagctgaagatcggcgacaccgtcaaaatcagctacgtggaccagaaccgtgagggcctggatccgaacaagaacctgtgggaagccgtgtccggcggcctcgacttcatcgaggtggccggtgtggaggtgccgacccgcgcctatgtggccagcttcggcttcaagggcgccgatcagcagaagctgactggtgtgctgtccggtggtgagcgcaaccgtctgaacctggccctgaccctgaagcagggcggcaacctgctgctgctcgacgagcccaccaacgatctggacgtcgagaccttggaatccctcgaaaacgcgctgctcgaattccctggctgcgctgtggtgatttcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcgcctacggcaacacaccggcagcgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacatatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggtgcgcgtgccgtaggaatagtcacccctaccgcttgtaggcttgggctatgtcgctacggcgcttggcttccctgattttcgggttttcggggccttcgttcggcggtagctggcacaaccattcgccgataatgccgatgatcatgtcggcgatgcacaccacggccgcaattgcgcactcggtgacggcgtgtgcatagaaatccgcctcgatatggctcaagctcaccacaatctgaccgccataccagccggcgagcgttgcgcccgccaatcccagtgcctttgccaacaccagcgtatacaccgcgatagtgggattgatgaagctatgcggacgtttcttggggtcggtattcgcgtatttatgcacttgcagggccaagatcagcacaataacgcccagtacggccagcaatccgggcacaatccaaggcgcaccaatcagcgacagtcccgagctttcgccgtaggaggccagaccgatacccgccaacaggcccaacacggcaccgatcacatactgccaccatggtgttcgccgtgttttcatgtccggcctccttatcgttgcgttgctgtttgctgtttgcgaacggccttcgcgctttggccgttcatcttgatttgttttttcgtcattgccgtgcctggctgctcgaggccggagactggtccgtcaccgtctggtttctagcctaccgttcgtaactggttccgccatcagctcaactattcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgccaggtcatgaacgctttcgatgctgcccaatacggcaatcaggtcggcgggcggcaacttggtttcgatttggatgaccgcgctcatcgcgtccggactgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccagggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaagcagcgcgtcaatctcccgaacggcggctcgcaaggtggattccacctcgcccacattgccccccaaggccaccaccgcgttatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggtgagcacaccgtgggtgccgttggcatgtacgccggtaagtgtgatggtgtccattggtaaggctttctgttcaaatgctccccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatggtcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgacgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaacgtcttgacggcaccggtgatacgggccagttcgtcggcctcggacacgcgcttggcaccaccggggcgcgtggattcggcgccgatgtcgatgatatccgcgccggcggccatcatgtcgcgcccgtgctgggccgccttggccgggtccagccacaggccgccgtccgagaacgagtcctcggtgatgttgagcacacccatcaccatggtgtgcgtggcgtcatgcaacgcctgcaaatcagtcataggtcatctccccttcattgtttccccttcgctcccctcagtcacctacggcgacagctcccctcagagaggggagcctaggttgcgtcacttgtcaagaatcagactcatggcttcggctcgggtggcggggttgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcggtatccacgtcgaagtgcttctccagcacatcggccggcgaggcctgcagaccggcgaacagctcgcggcacgcgcgggcgatacggtcaggcgtttccaccagtccctcgcgctcgggatcctcgccaatcgacttcaggaacagacgtacggcttcgcgcacgccttcctcgtcgtatgtgcgtttctcccgctggcaagactctatattttcgttcatctcatctctcccttgtcattgtccacaacgacgtcggcccggcctgcgtacgtgagaaaccacatgaacaggtcgggccgaatcgtcatcgtgtctactcttccggcttcatcccgaccgagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccagcagctggcggaccagctcgtcaagaatctcgcggttgtcgttgatgatggtccatgcctcggtgtgcgcggtctccaccagcttcaacacttcgtcatcgattacttcagcagtacgatcggagtacttgcgcggctgcagaccatccatcacagtggtctgatcgtcgtcggaaccccacttgatggcgccgagcttatcggagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttagacttgcgcttcgggccggtctgaacgcggtcgatggcctcgtcgatggcgcggttgtcgatcaactgggcaccggcacgggcgcacagcaacgcggcttcgttgagcacgttggccaaatcggcaccggtgaagcccggcgtgcgcacggcgaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggcgatgatgatgaggttggtgtcgttgtcgaaaccgtccatctcgacgagcagctggttcagcgtctgctcgcgctcgtcgtggccaccgcccataccggagccacgcttgcgacccacggcatcgatttcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttacccgtgccgggagggccgtacagcagcacgccgcgcgggatgcgcgcacccagcgccttgtacttggacggatccttgaggaagtccttgatttcctcgacttcggccacggcctcgtcttcaccggccacatcggcgaacttggtggtgggggtctggccctcgagcagcttgccgctgttcttcttgccgcccatgccgagcatgccgccggcaccgcccatgcggctcatcagccaccagaacaaggcaaggatgatgacgaacggcagaatcgaggtgatgaggtagctcatcacactggtctgctcgatattcgaggtccagcccttttcgagatcgccgttctccacggccttggccacctgtgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccatagccaaggggactgccatatcgggcggttctcgttgttgttgcctttgccattggtcccgttattgccacggttgaacgggttggtgaacgggttgccgttgttacggttgttgttcgggttcggattattgccgttacccggcccttgcgggaagctcatgcttgcactccttggtagacggacggcttgaggaccgcgatcgaatcgagattgcggtagcgttcgtcaaagtcgaggccgaagccgacgacgaactcgtccggaatctcatagccggcgtacttcacatcaacgtccacctctcggcgggagggcttgctcagcaaagcgaagacctccacggaagcggcaccacgacgtttcagttctgcgaccagccacgcgagcgtgtgtcctgaatcaacaatatcctccacaatcaagatgtgccgtccgcgaacatcggcggacaaatcctgcctgactgtgacctcaccgctcgacactgtgcccgagccatagctcgacaggctcatgaagtcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcaatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgatacagctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgttcggcaactcgccgtctaccgcatcgccattggtggggtcatcccaatattccacacctaagtcttcacagataccggtggtttcggctcgagtaagggtaagcagtggccgcgcaaaagtcgcgccactgcgtgtgaagacctgcggcatgccagccaacgcatccacgcctcgactgcgcagcaggccaatcaatacggtttccgcctgatcgtccatagtgtgggccaacagcacggcaatggcacccgattcatgcgccgcggcgcacagctcgtcataccgggcctgccgtgcggccgcttcgaggccctcgccgcgcgcctgtacggttgcgttgcgcatgatgaccgggcccagtcccaacgcgtggcaacgatccgcggcctcgctggcgacctgttcggagcctgcctgcaagccgtgatccacaatcacggcaccgcaacgcacgcccatggacgtgcatacgatatggctcaccgcagccagtgccatcgaatcgcgcccgcctgaacaggccacgagcacgagcggcgcatcggcggcaacggcatggtccccatgctgcgcgaattcgggagcctgcacatcgcatagttccacggcactcagcgttgcgcggaccgcgcctacggccttgcgcaatcgtgcggaatatgccatgtactcaccaccttttttctggttataggcactcgtgcgtttatggacgtttacggcctttatagcccttgatggcccttgatgcctcttttacagccccgcgagcttggtgataaacgagtcgatggcgctacgcgcggcggcataatcctcaggattgttgaccaccacggcaaacgacaacgctcccccattggtgcgagacacattgccggccatcgacgtaaccgtgccgaggctgccggttttgacgcgcagcagaccagccacggcatcatccgtataccgatcctgcgccgtgcccaccaatcccgcgatggatagaccttccgcaccagcagcaccgctctcggtggtcagattacgttgttggacggccgccagcgtgcgtacggtgagccgggagccgggagacaggccggagcaatcggccatggtcagaccggatgtgtcgagaccgagatcgttcagagtggatttgaccgcttccgtgccgccttcaggactgtttgtcgctgatttcgccaaggcggtgagtctgccgaactcctcggccagcgtattgtccgaatgccgcaacgtgtatgccatgatttcggacagtgttgccgaactcaccgaagccaaaggcgtttcaccggatggagcggtgtttgccgtcacgtctccggtaacggccatgccgttcgattggagcagttcggcgaatttcgcggccacgtcgctggcggcgtgctgggacagttccgggtatccggccgaatcatcggggtcggccggcgcaggcgtatcggcggtgtattggcggcctccatcaatcgccattgatgagaccggcgtgaagtagacggtgtagtcgcttaagactgcgccgccttccgacagacctgccggaatgcgtgagtcgccgaatagggtgtcgtcgtactcgagattgacggaagtgatgcctcgctgggcgagcgcggccacggtggccttggccaaggtgttcagaccggcacgtccgttggtatggttggcgtcagaatcgcctgcagacagcagcatgtcgccattgcctttgagggtcaacgtattggtgccgtcatcggattgggtgaggaacacttgggtatccaaggtggatgccatattcagggtggatgaggcggcgagcgcggtcagcgttttcagtgtggatgcaggctcgcgtggagtgttcgactcatgttcggcagcgacggtgccttgggcgtcttcaatgatcaccgacgtatcgtttcccacgccttgcgcggacagcaattcgttgaccagcgcagaagcggccgtggaatcaatggccttgttcgcgttcaaggtgccggcgacggtgccgcctgatttggcggtggctggatcggcaaaaacaggtgcggcgacgggcttcaacgtcaataatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgccgctgacggcgtgataccactgtagataccatcgtgctccttatgccaaggcgatcatttctgcaatgaggcgaacgagtcgagtgctgccacaatcgaaagcattcgcgcatccatcagcttaccgcccagccatgtcccgagtgccaggatgccgatgccgttggccagtgcgaccggaataatcgccagccatatgccgccttcggctcccgtcagcagcatgaccagcgccacgatgccggtgggcagcatcagcagcaggctgccaagcacgtagacgaacgggaagaagccttgggccatggcgcggccttgaggcgcggagaacggcttgtccattgaggcgaccgggtacatcagcacacaggacgtgacttcggccacgcccaggccgctcaaggcgacgcccatgcccacggcgaggaagatcaggccggtgacgaggtcatcgggctgcgcccagcggccggtcagtgcgccgaccagcacgatgccggcgagatagagcagcaccatgtagacgaccatgatgccgacgtagacgcgcacgcggccgattctgtcggtccggccacgcacgccggcgatgacttccatggtgaagccgcggccgtcatatgcgagcccgttgctttccaccactgacatgaaccagccacaccagatcagcgactgccagacgaccgcgctgatgccgtgcgcctggaaggcgaagatgatcaggaacaggaccggcatggcgaaggtcatggcttggcgggggtctcgtttgagataggtgatcaggcgtgcggacaccgcgccggatgccgaatcgggcatccatgcgaatgcgccgatgcctttggcggtctcggacggactgtttgcgccgatggtgagccgttcatgcctcagacaccaagtgcatacggcgaagcagacgatccatgtgacggcaaggatggcgatgcgggcgatcagcaccgcccaagctccggtaagcgcgtcgaacggcagttggaaggccgcaccgaacggcgtccatgcggcgatggcggtcgccgcgccccaggtctcggtgttgaggctgaaggctatgccggagttgaccagaatgttcggcaactggcagatgatgacgaaagtcagcacgatgaagatgtagaacgcgcctttgccgcgtttgctggtcaccagcgtggtggatagggcgatgaccagtttggagatgctcatcatggtgatgacggccagcactgcggcgaggagggaactgatgattacggctggtcccatatgccgataggccagtgtccagagcatcagtgaggccacgccagtaagggaggggatgccggacaggccggaaagcagcaagccgaattgcaggttgcggtcggcgatgccgtagatcgcgaatttgcgtgggttcatggtggagccttcgccaagcatcatgagctgaatgaagccgatgaagatggtcatggtcgcgccgaccagcacgacgactatgttgacgatgcctccgggaccaaggatgttcagcggaaagccatccgcgttcacggtgaagggcggcagtatgccgatgaaccatgcgagcacgccggtgccgatgatggtgccggccgcgagtacagcggaaaagacataggcgacggtctgccacgccgattttcgcagggtggcgagcgtgagcgtccagcgcaggcggaccagggtgatggcggtcttgatcattggcgggcctcatcggtgggtgtggcgggcgtaggcagaatcggctgaatcgtctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgtcgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcattgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtgttcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgtattcgggttcggcggccatgcttgcggctgtggctgttgcgactgcgaagacgcgggagcggcggctggcatcatcggcggctgaaatccgacattcctttgagtattgtctaagctcatgcatctactctagaccaccagtcaaccctcagcgcagcacccccgggttgctgttggattgccccgctgagcagctccggactagcggactcggtcagcccttatgcgcgatgggcttccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcaggcccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtggcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggcgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggacaccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccagcggttcgacggccagcgccaggaacagcgagatgatgatgtcgagcaccagataggagatgtcgccccacgagcgccagcagaacatgaatacgatgacggcgagggccacatacagcagcgcgcggccgaaccattccggtggcctgcgggaatctcccttggcggggaacaaagtaccaaagtcgatacgattctcgtcgtccgggtctgccccggcctctgcggcaccggttctcgacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcggttgtcgaacagttcattgccgaacatcccgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatggctgccactggtccggtgatgtattacgacatgccctcacgccattttgggttgaagggcgacaattccttgcgcaagcgaatctaccgcgccgatggcggccagccgctgctgttcggctcgaatatggccttgcgcgcttcggcctggtatcagatcgcgaatgaggtctgccgggataaggccgatgtgatgcatgaggatatcgatatttccctgcatctgatgggcaaggatctgaaaaccgtgtactcgccgcgcatgatcgccgcgatgagcgcgcgacggatggatacgtcgttgagttcgttcctgaactacatgcgacgttttaagaatacgtttgatgcgcatccgcaacatacgcgcacgcataagccggaggtgttgttcaccgccatgtatccggcgatgcatatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctcgatatacaagccctctctgcttatgcaagctccctctgataagggagctgtcgaacgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcatcgactgatcacatcagcgacttgtaaatcgcgaggatgtcctcttcggttgcctgacgcgggttgccgggggtgcacacgtcgtggaacgcgtcgtgagccagcggctcaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggaggcgtaggccatctgttcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatggagtcggtcagatccgggtccacgaaagcgacgatcgggatgtcgtgcgggtcgacggccacgaacttgcgcttgttggccgtgtcggtgaccacgtagttgatggtcgtctccgaggcggtgcccgcggtggtcggcacgccgaagatcgggacggacgggttcttggtatccgcgacgccttccagggagagcacgtcggcgaactccgggttggcggtgatgatgccgatgcccttgcaggtgtcttgcggggagccgccgcccagaccgatcaggaagtccgcaccggagtcggcgaacttggcgacgccgtccttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgaccgaagtatgcagtctgattgaaaatcatgcggtagaccataggggctctccttttgagctagtgtcttaactgatggctcactctgtctttgagtggtccaacggttccccagtctactccgcgcatgagcattcacctgaaaacacgctgaaagaacaacactgaaaataatggcaagaaatggcgtaattccgcacttgtcgaattattgtccattgaccaaaccagttccatcgcccgaaatctcaacgataaaaccgtttccggagtcatctgacgctctccgagaaactcgtctctcatccgcttacttcgcgcgtagcgcaatcaatatgcgagatgcctaattccattcgtgcttcatcagccgaacgcgaactggttcaccagatggtgtattcaacggtttcagtctcctgaagaggactaagatacctcgacagttggggtgatcatcataagagaatgaggtagataatggcaaatggcaaagctatgacggtcggcgagatggcgtccctgtttctcgaccccgccactcccgttcgtatcgacgctttcgacggctcgcatttcggcccggcagacgcggatttgaaggtcaaaatcgccacgccgaactgcatgtaccagctactcgcgcacccgaatgaaatcggcatcgtgcgctcatacattctgggcgatttcgacgtggacggcattgactacgccgacccgtatccggcgatgcgcaagctggtgtcgctgtccaaatacgttcgcccactcactcccacatcaattgcccgcgtatctgccggcatcctgagccatggcttcaagaagccgccggtgcccgccaccgagggcccgagcaagttcgcccgtatcaagcgtggcctgatgccgcacacagaaaaggccgattcggaaaccgtcagcttccactacgacatgtccaacgagttctacgccgacttccttggatcctccatgacctacacctgcgcggtattcgacaacgagcacatgagccttgaagacgcacaggccaacaaactgcgcctgattctcgacaaactggacttgcagcccggccagcgcttactggacatcggctgcggctggggttcgatggtcatcaccgccgcccgtcgcggcatcaaggcgctcggcgtcaccctttccaaggaacaggccgcgtacgccaacgaatggatcgcccgtgaagggctgcaggatctggccgaagtgcgtgtgcaggactaccgcgaggtgcctgagcacgacttcgacggtatctgctcgatcggcatgatggagcacgtaggcgtcaagaactaccagagctacttcgaagagatgttccgccttctgaagccgatgggccgactgctgaaccaccagatcaccatcagccatgacaagcctcacggcaagcccggtaccgacgaattcctcgaccgttacatcttcccggacggtgatctcggcgcgcccggcttcatcgaatcgtgcatccatgacgccggcttcaacgtggtgcatcaggagaacctgcgccagcactacgcgctcaccctgcatcactggaaccagaacctctccgagcattgggacgacgcggtcaagcaggtcggctttgaacgcgccaaggtatggggtatgtacatggccgcctgcgctctgaacttcgagctcgacggcatccagatccaccagttcttggccgtcaagccggatcgcgtgggccacccggacggcaagtggtaccccctgcgccaatggtggcaggcctgactccgtttctgtgggacggcacgcggttttttaccattgttcatctgccgtcccacacgattctcttcgcacgcgcatttcgcgggtgctttttctgcaatactgactctacgagcgccacagccccgacacggctggggcggacgatcgcaccgaccatgacacgcgcggataagacccacgtttctttacttaacctgatgttcgcattggtgctgttggcgtgcgtagttgcggcaaggaagacagttgttggcgaacgcgagcctttgcattgaccggccagcccgccattttggcctataacccccgccggagtaggtacgcgacggatatgcaaaagccccgcacaaggcggggcttcattatggtggctccgaacggcgtcgatccgttgacctagcgattttcagtcgctcgctctaccaactgagctacagagccatgaacagtcaaaaacccggataatccgggcttcataaccattccagcgaccccggccggacttgaaccggtgacctccgccgtgacagggcggcgctctaaccaactgagctacggggccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccggtgacctccgccgtgacagggcggcgctctaaccaactgagctacggggccattgttctcacttgcgtgaggcaacagatgtatatattactgaaattcgccagtcatgcaaacttcggcgtgttccgcataatttcaaggtttttgctatcaccagcacgcgaacacgtctgtcacaaacatccacaaaacgacgaagggcgcgaccggaaccccggccacgcccttatggacggaaacgcttcgcggcatccaccgcaaagtgaccgtcaatctcagtcagcctgcttccaggtgtcgacgtcgatgtggtgttcggggttggcctgccaggcatcccacgcggacttgacgatgtcttccacgtcgtacttggcatgccagcccatctcctcgttgatgcgcttcggggagccgatcaggtgcggcgggtcgccggcgcggcgggccatgacagcctcggtgaacggcaggccggtgaccttcttgacttcgtcgacgatctggcgcacggaggtgccttcgccggtgccgacgttgaaggcgtcgtacttgcgctcgtcacggtcgaggtacttgagggcggcgatgtgggcgtcggccaagtcggagacgtggatgtagtcgcgcacgcaggtgccgtccggagtcgggtagtcgtcgccgaagatggcgggagccttgccctgcttgaggcgattgaacagcatcgggatgaggttcaggatggccggatcctcaagctccaccggaccgcagccggccacgttgaagtagcgcagcgcgcagaagcggatgccgaacggctgctcgcaggcgcgtgccatccactcgccgaacagcttggtctggccgtaggggttgatcggcagcatcgggacgacgtcctcgggcaccacatcgaccggcggcacaccataggtggcggcggaagaggagaagacgagcttcttggcgttcttggaccgggtcatgccggtgagcacgttgagcatgccgttgatgttctgctggtagtaccacagcggcttctccacggattcgccgacctgcttgcgagcggcgaagtggatcacggagtcgacgccttcggcatcgaggatttcggccagacgctcgccggcgcccggggcggcgatatccatgccgtacaggcgggagccttcgatgcgagtgggcttgccgtagctcagatcgtcgacgacaacgaccttttcgccggcctgatggagtgcgtgaacgacatgcgcgccgatgtagccgcagccgccggtgacgagaactgtcatagttgacctttccttgtgcgggttgcaagtgtcggccgtggggagttcagcggctgttcacttttggtccgctttgttaccttttgaaacaatttgagtatatcacacgaacataatcgcacaaaacggtggtgtcgtccggcaatatctgcattcattaggtcgatttggcgttcattaggtaggtcggcccggagccggcccgcacggacaccgggtaaacggcttgatatggtggttggtatcgcacaccacctacctaatgaacgccaaatcgacctaatgaatgaacagcggtgcggcgcacaaggaaaatccgaggaatatatgaccaatcccgaatccacagcaatcgatcccgtcgccgcgatgggcacagaccacaccgaggcaccggcgcaccccctgcacaaggtgctctccttcgtacgccgctccggacgtttggacgatcgcctgcagcgcgcatgggacaactatgccggcacatatctgttggatattgcggccggcaacctgctggacgtgcgcgaaggcgtcacgctcgaccgcgcgttcgtggagtccgcatggggcaacgataatccgctcattgtggaaatcggcaccgggcagggagaaaacgtggtggcagcagccgcagcccacccggagacgaacttccttgctctagaggtctatgaccccggcgtggcccacacgctgctgctcgccggcaagcaggggctgaccaacattcgcgtggcccaggtcaatgcgcccgagctgttcaaggtgaccgcggccggcaccgtggccgaggtatggaccttcttccccgacccttggcccaagaagaagcatcacaagcgccgcatcgtgcaggaggccatggccggcgacatccatcgcgcgctggccgcagacggcgtctggcgcatcgccaccgacatcgaggactatgccctgcacgtgcacgaggtgatggacggcctcgatggctggaagaacctgggcagcgtaaccgtcagcctgccgctggagcacgtgggcaagggcaatgccgacatggccgccgatatgccgcacgccgacttcaccgaatccgagcgattcgagggccgcgtgctcaccaacttcgagaagaagggcctggccgccggctgcgtgattcatgactttacctatcaggccgttaccttgaactaatcacgacacgccgaaatgccgtcgatttgcataaccgaacaacctcccgtaaagtaatttgagttgttcgcccccatcgtctaacggttaggacaccagactttcaatctgacaacgagagttcgactctctctgggggtacttcactaaagacctcggtcatagcgaccgaggtcttttcgtattcgcgggaccaggtctgacgatgtgacatcctccacactgtgacttcgcgcacagggtcccgacgccaccctcaccccgtttatcgacaccatgcgtgtataaccgcatatggcatcatcggcgaacatcggccggcagaccagttgtacaaggagaacatcatccacatggcagacaccgccaacaccaacaccaacgcctggctgccggcgctcaaagcggcgtttccgctgaccataccgatttgcctggggttcctgtttctcggcgcctcgtatggcattctcatgggcaccaaaggcttctccttcgtatggccgatgtgcatgagcgcgttcatcttcgccggttcaatggaattcgtcacggtgaatctgctgctctccgcgttcaacccgctcgccggctttctgctggccctgatggtcaacgcccgtcacctgttctacgggctatccatgctcggcaaattcaaagggctcggctggaagcgcccatacctgattttcggtatgtgcgacgagacttttgccatcaactccaccgcgaaaatccccgccggcatcgaccgtggctggttctacttctgggttacgctgtgcaatcagctgtattgggtgaccggcgccacactgggcgggctgatcggcgcgcatctgccgttcaataccgacggtcttgatttcgtactgaccgcgctgtttctggtgatcttcctcgatcaatggctcgacggcaagcatcgcgagcgactgtccgccgtcatcggtgtgctgacatcactggcctgcctgctgatattcggggccaatgatttcatgattccctcgatgatcgccatgctgatactgttcgtcgcgttgcgcccgcatctggacgtgttgcggccagccgccgacgccccggaagccacggcaaaccatgccatgagccacgcagcggaccagcagaaggaaggacagacgcgatgacgatgaccatctggcaaggcgcaatcactatcgtgacggtggtgctgggcacgatgcgcacccgttttctgccgtttctggtgtttcccgagtccaagcagccgccgcgcatcatcgagtatttcggccaggtcctgccctatgcgatgaccggtctactggtggtatacgcactgcgcaacaccccgattctgaccggttcacacggccttccggaactcatcgcctgcaccgtcatcgtgctgctgcacgtatggaaacgcaatatgctgctttcaatcgccggcggcacaattgtatatatgttgctggtgcaactggtgttctgaggcacccgactcgttagtctctccctccgcttcgctatgctcagcacctcccttacagagggaggtaatcttctgtaccttcctctgacgagggaggcggcaccgcgaagcggtgacggaggtagagacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggccggcagcatgcgcagcagggcgcgcatgtgggaggcggtcatcggcaggaacaggtcggtacggtcgatttcctcacgcgagatgcggtgtgcgaagtggtcacgcggaatctcatcaccatagccacgttcgcgtagcacgcgcacggcacgcgggtcgatcgggtggctccactcctcgtcggacacaccgctggattccacgttcacctggtcgccaagaccgcgctcattaaagaagtgacgcagaatgatctcacccataggcgaacggcagatattgccggtgcagacggtcattacggtgtagggctgggtattgctcatagctttgaatcaatcctcaatcgggcttcaccgggccgcacacggcccgactgtattgttggggtcgaatgaatatgaatccggctcatgccgctataaagggcataagccggattcgcatgcttacttggttttggccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagccttggcgaacaactgggcgccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgccccccagcgattcccaggtcttacgacccataatcaccggatgggagacggtcagctccttgaaatgcttcatatcctcggcacagtgccaaggcatgccaccattgaggccgatggcaccggcgcgaccttccttgtcacgggcttcggaccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcgggggccgtcaccttcacagtattcgctgtccacgaaacggtaatcagcatcagaccgcaacaggtgccttaatagtggggtgatgctggtagccgacgaccttgaagtcctcatactggtagtcgaacagggaatcggccttacggatctcgatggtcgggtacgggtagggcttgcggcccagctgctcaaggaactggtcgacgtggttgtcataaacatggcagtcgccgccggtccagacgaattcgcccggcttgagcccggcctgctgcgccatcatcatggtgagcagcgagtaggaggcgatattgaacggcacgccgaggaacatgtcgcaggaacgctggtacagctggcagcttagcttgccgtcggccacgtagaactggaagagcgcgtggcagggcggcaacgccatcttctccacctcggccggattccacgcggagacgatcatgcggcgcgaatccggatgatgcttgatgaggtcgagcacattggagatctggtcgatggtgcgattcgggtcctcgggggtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgcaccaggtcctcatagggcatcggaatgtccgtttcgggacgtgcggggatacgggagcgaatatctgcgagttgttcttcggtcaaagccatgtgcaccagtgtagcttaggggcataatagagaagtccactgatgcgggagagcggccaggtgccgcgctcccccgctggcatggcgatgggccagatcgccggcggctgaaaataaaggagcagctatgggtaagcgactgtgggttgagcgtaacaaggacggttcgtgggatgcgttcagcgacgatggcgcacacattaagttcggcaaggatcgtggccagttcacgccgggcgatctgatgaaggtcgcgctggccggttgcgccgcgctgtccagccagttcgccatcgaacatacgctgggtgagggcaagggtgccaagattgtggtggatggcacgtacgacccggaaaatgacgcctacaccggtttcgaggagcaggtggtgattgatgcttccgacgccggtctgtccgaggaggatgccgacaagctcaaggagcgcgtcacccgccatatcgacaagggttgcacggtcaagcacacctacgtgcaggagaccccggtgcgcatgaacgtcaccgtcaagcactgagacgggatataaattgaagaggctccctggcgggagcctctttccgtatattcggactttactggcgatcgggatcgatggtcttttcgatctgctgggcgacttcaggctcggctgcggacaccggaatctcctcgacgccggcaatctcctccagcgacttggtaggcacttcggcgggcgagctcggcacggtgtcgagacgcgattccgcggcctcaacatacttgcgtggcaccacgtacaccgggccgaccgcatgctgcagcaggccctggctggtggagcccagcagcaagccagtgaagccgccgcgaccacgggagccgacaacaaccacatcgtgatcgtagctggccttggtcagggcgctcacggccgggccggaaacgatctgcttgttgatcttcagatcaggatgcgattcctgcaacggcttgatgcgcacctcaagatcgtccttgtaggactccatgacggcgtcctcgccgtccacacccttcaggttcggcacagcggaaatcacgtccagttccgcaccccagcacgtggcgaagtcggcggcaatgtccagcgccttcagaccccacttggattcgtcggagccgacggccaccttggtgatcgtgttgttcaggtgcatcaggttaccgtcatcatcggtgtacggcaccaccacaatcgggcagtaagcatatgccggcagcgatgaggacgtagtgcccagcaggcgctcggccagaccgcccttgccacggttgccaatgacgatcagattgtagttacgagacaattcgacgaacaccgatgccggatctccggtaacaatcagtgtggcggcttcgacgccctgctcgtctgcgatggccttggccttggacagaatctcctgagcatcggaatgcgcggcgttatcgtcccccatcgccgtgtaagtggcatcgaacgaaacggcggcatagctcggcagggaatatgcgcagacaatctgcagcgtcagccccgcgtgctttgcataattcgcggcccaccatgttgccttgtaactggcatgcgacccgtcaacgccgacgagaatagccttgtcgttaatcatgacgacctccttgaagttattgcggcacgaataccgcgtatctcaacaataccccgcgacactcggtttggccggtatcctccgctcaaaaagaaatccgcgtacacgaaaaaggcacaccccaaaggacgtgccttaatacgaattcgcttaccgcataattcttgtcacatcacgcggcgaatggaatatccagctccaccgaatacggaaacgtcgcttactgccgttccctgcaccgggttcatagcattcatcacctgtccgttaccgatgtaaatggccgcatgagtaccattcgcaagaatgtcacccggcttggcatccgccaagcttgcgaccggagtacccacggtggcttgagcaccagaggtacgaggcagggagatgccaaactgggagaagacgtactgcacaaaaccggagcaatcccatcctgccggagtgttgccgccggcaacatacggatagccttggaacttcagtgagaagctagcaagctcagcgccagtgccagtgccagtcattttacccaagtcaacctgtggaatcgacgcacgctgttcagagcggctggctgccgcagcagcagcggactgggctgcagcagcttcatcagcggctttctgagccgccgccgctgcagcagcttccttctcgccctgagactcggtctgtggcacatcaagagtctcgatgccaccccatttagagttctcatcaaccgaggtggaggtggattcggcgaacaaattcttcttcaccgaactcgccttcgggaaagaacgtgaggacaccacagcactcgtctgcgcggaatcggcagaggcaaacggggctacgcacgcaaacatggcacccgtggcgataatcgccactgatgtggaaataatagtcttaacgctcatcatcaacgccatacactagcacacatgggtcgatttcataacaggaatagcatttcgaagatgatgtcgcgggtgcatcattcggcaggagaacgcaacaggcctcggataccgatcggcatccgaggcctgcaataaatcaatcaataagactgcatcacgggatacgcaccacgatggtgagcttttcggtcatggcactagcgagagccacgctatagccattccatccaccatggaccgcctgaccgttgccgacatacaacgccacatgatcgtagtgtgcaccaccgttccatccaccggtgttggcataaatcagaatatcgcccggctgcagggatccgtctgtgactacgtggccaccaggaacattgacgtactcttcaggccaaccgtggaagttaatgccacgggccgccaacgcttgactgaccaatgcggtgcagtccatgctctgtccgatcaaagaatacgcacggtcgatagaggcaccggcaccagcggaaaccgaaccactggcatcggaataagtaacagaagagcgagactcattacggctcgcggcgttggcctgctcctgggtcgcctgagcctcgacctccgcctgcttctcggcctcctcttcggcagccttcttggccgctgcggcatccttttccgcctgagattccgtctgcggcacatcgaggttctcaatgccgccccaatcagcattgtcctcaacgctcgtggcagtggcttcagtcgtcagatctttgcgcacctgggtgtacgaggggaaggacttggtggaagtcacagtaacaccctcagctgcagttgctgtaggaacaaacataaacaagcaggcacaggagacaatcgcggcaacaatggaagaagctacagttttggtcttcatagaaccatcaccctacacggtgcgcattaactcgtacaggatggaagaaataaaacaccccggagctattgggatatatcggcgtgtcggcacaggtcagttcggactaatacgtggccgcaacacttgaaatgtcatttcgcgcgaacgattgccgatagggcgacgtcacatccgaacagtaatcaccgaatgtaagccaatgaaatgaatcagtagtgaacgtactggaacttaccggcttcggcggcgctgaacgtacgggtcgaaatcacacccaatcccttggcattggattcggagatctcaatggagccgtcggcattgatcttttccagaacggcaacatggccgtacgcgccatcggcatcggcctggccaggagcgaacaccacagcatcaccgacatggcgaggagtgttgtccacccaatagcccagagcggaagctgacgccgcccacgcgccaccattgccgaagttgccgctggaaggcaggcccagttcggcacgacgctggtacgcgtaccacgtgcactgaccccacggatagttgttggagttggtgccaacggcatggttcgggttgaagccagccggcacagcatcgccatcggcatccatgagagccgacaccacaggattgttcgcattattgcgattcatcagcttggcgtccaaggtgctgtctgaattgctcagcccccaaccgccttcattggtggactgtgcggtaacggaggatgaactcaaatcagtacgcgcttcggaacgagaagccgcagtcacatcgctgatgcgcttaatctgcgtggtcgtcgtggccggatcagccacgaacgagttcgtggcgtcttcattgttggaaaacgcgagagcacctgcggccgtgccgaccagagcggccagtgaggccgaggcaagaatatggctacggcgttcagcggcacgagcggcctcacgaatggaacgacgagtctggggagcgatttcgttgatcttctcggcaatggccggatcaagccccaaaacaacagcgtcgctaccagcggattgcaccgcgcgcacggcacgaacggaatgagaacccttgccggaggcaaacaatgccttcgctaagctgaacttctggcgcgagaccgtggtcgctttatgcgaagcatgcttcatactacgttaactccttggatgggttcggcggggtcatttcgacgacctcgtatgaccgtcacaattgagtactgtacaacgaacagaggtcaatcctcaatgtgatcccccaccatcagggtgtgtcaaacgatttacgtaaccgtgcggccgggtgaaaaactgccttgtttccgcccgttcacgaacctcactatccggttatcggaagaatcactaactcatgtcattccgacacaccgtaaccatgatgtgctgcgtacattctgcactgcattccgcattgccaccactgccgcccggcaccccggaattccgcagtaaccccgcagtaatcccgcacaccgagcattatccgcgatattccccaacactggtctacccttgaaaccatgactatcacactgagtattcccgagtcgctgaagcccgaagatggtcgcttcggctccggccccagcaaaatccgccccgaacagatcgccgcgctcgacgccggcgccaccaccctgcttggcacatcacatcgccaggcaccagtcaagcaactggtcgcttcgattcgtgaaggtctgcgcgagttcttccacctgcctgaagggtatgaggtggcgcttggcaacggtggcgccagcgcgttctgggagattgcctgcgcttcgctgatcacccgtcgcgccgcattcggcacgtatggctcgttcagtgccaagttcgccgcgtccgccgcgaacgcacccttccttgaagacccggtgctgttccccggcgagccgggcacttaccgtctgcctgagctcaccgagggcgtggacacatattgctgggctcacaacgagacctccactggtgtggccgccccgattcgccgcgtggccggaagtcgtgaagctggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacacgttgcgccaagtccgcatccatcctgtactcgtgggccgagcgctccgaatacgccgctccgttcgtcgtcgatgcggacgcacgctcgaacgccgtggtcaccattgatctggacgagcgagtccaggcctctcaggtactgtccatcctgcgcgagaacggcattgtggacgccgccggctaccgcaagctgggccgcaaccagctgcgcgttggcgtgttcccctcggtggaaccggctgatgtcatggccttcaccaagtgcgtcgactacgtggtcgagcacctgtgatggcggtctatgcctcgcatggccgaccatatatgccatgcacattgatcggtctcgactgatgccgattgaataaatcgtagggagaggtgtttgacgcccctccctactcttactacagtgcatgagtatgaagttcgcgcctctcattgaccctgccgtccgcaaacccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggcgtcattattggcttgctactgctggtctgggaatacttcgaccgctgggactaccgccgcctcggacagtaacgcaacacaagctccctctgatgacgggagctgtcagcgtagctgattgagggagagaccgcggccgcaggtcgctcatcaaacagcattggtggcatgcaaggcatgccaccaattccttacctcactgcgccaacggcaacgtaaggctgaacgtactgccttgcccgggcgcgctccatacggtcacatcgccatgatgggtcagcgccacatgcttgacgatggccaagcctaggcccacgccatccgccgtgcgattgctctgttccacgccccggtagaaccgctcgaagatgcgcgcctggtccttcttagcgatgcccgtgccttggtcaatcacgcgaatcaccgcgcggtcgccatccttgtctttggatgcggacacgctgaccacgccattttccttggaatagccgatggcgttttcgatgagcttggtcacggcgctgtcgatctggtccgcctcaccattgatgactagatcatcgtcgcccttgatgttcagctgcacgccagcctcggctgcctgcggctccagtcgcgccgccgtggccctgagctgttccataacgttcagtcggttggcggaagacggcgtaatcggctcctgcgcgcgtatgagcagcagcaaatcagacaccatgtggttgagcttgctgcagctggaacgcacctggcgagcgtcggcagccacctgctgttcgtccagattgccggactccagcgaatcggcgagtttggccagagcctcagtggggcccaacaattgctcggacacattggtaataaacgagtcacgcacttgagcgaaacgaatcacatcactgacatcggtaatcaacacgatgacgaactgctcgttgatacgccctacagtcaccttcagccagttggggcggtggacggactgcgtggcgacgtgatcgcccttgttctggtctgcgacgtaccgctccggagtatcggtggtcaagtcgaactggcgcttgccaccggacttgcgcgcctcgtgaatggcatccagcacatgctgctgggcaatggcgtcatctgacaccacacccaggcggtaggcggcgggattgcagcggaccacctcgtcgtgctcgtcgaccaccacggacgcacctggcagcatggacagcagcgtggcggtgtcgtcggacagatcgtcattgtcgtcatcatcggccagcggcgattccatggacactcgatgtgtcgcaaatcccacgatgagcgtgatgattcctaccacaaataaaacagccgtgacaataagagcaatcgcggcgacgagcggcatctgtgtcatgcccccattctttcacaccacacgccgggattgcggtttgccggcacgccggtaacatgaatttcaggtgaacaacccaatgaacagtagaacaacttgaggttgccattacctacgttgaagtggggaacaagtactggaataatacactggtacaggttgcaataagcaagcatgaaaggctagagaaatgcgcgttattttcaacgaggagctgaagcaggttgctgacgacctcgaccgtatggcgcagaacgtacgcaaggcgatcaaaggagctggggaagccctgctgaatcaggacgttgaagccgcacagactgtgattgacggcgacatcgaaatcgatgccctggagtcctctgtgattgaccagtgcgtcaagttgctcgccaagcagaatccggtggccaccgatctgcgtgtggtcgtttccaccatgcgtctggcttccacgttcgagcgtatgggcgatcttgcccgccacgtggccgaggccgctcgccgcacctatccggccgccgcgattcctgaatccgctcaaccggtgttcgccgagatgatcgacttcctggacaacaccgctgaccagctggtggccatgctcttcgatcgcgatgccaagaccgccgaggccatcatcctggctgacgacaagctggacaatctgcaccaccagaccttcgatctagcgctgtccgatgacatcacccgtcagcagaccgtggatatcgtgctgctgggccgcttcctggagcgtctcggcgatcacgccgtgtccgccgcccgccgtgtggtgtacatcgtctccggcttcgaccccactaaggagccgacccgcgacgagggcaccgacatcgactgattgggacttgttctcacattgggcgaataactgaacacttgttctcctgtggtttgaggaggatgcccgaaagcggcgatccggctacggctggacgccgttttttgttgcttttgggcggcacaccggcgtatccatggggtaatcaccgccccatgggggatttggcaggcatagcaaaggggagccgcacgttatgtgcgactccccttacagcttgtaccgtgttagcggcttaggctcacttctggccctgagcggcgacagcggcggcaccggcagcagcagcctccgggtccaggtactcgccacgcggcttgatcggcttgaagttctcgtccagctcgtagagcagcgggatggcggtcgggatgttgaccttggcgatctcttcctcagacaggttgtccagcatcttgacgatggcgcggagggagttgccgtgggcagcaatcagcacggtcttgccggccttgagctccggctcgatagcggactcgaagtacggcttcacacgctcaacaacgttggccaggcactcggcttccggaaccggatcgccggcgtagcgcgggtcattgttctgggcgtactggtcgttcgggtcgatctcgggcggcggggtggcgtaagaacggcgccacagcatgaacttctcgtcgccgtactcttcgcggatctcggtcttgttcttgccctgcagagcgccgtagtgacgctcgttgagacgccagtcacgctgaaccggaatccacagacgatctgcggcatccagagcgatgttggcggtgttgatggcgcgacgcagcagggaggtgaacacgatgtccggaaggacgttcttctccttgagcagctcgccgccacgcttggcttcggcttcaccctgctcggtcagcggtacgtcgacccagccggtgaactggttagttttattccatgcgctctgtccatgacggagcagtactagtttataagtcatacggttcagtctacagccgcgtgcgcccaaacacgagtattcgtcttattatttcgctctcagagcgtcacggaaaccgccagcaccaccgcaaacagcaaggtctggaagctggcggcgggcagagccgggcggaattgacgtttattcacgctggagaccatgcgcacaggtattccgacgcccgagatcaacagcactgcgccccacggccaccatagggtcgcgcacatgagcagggctatggcccacgcggccacgcagcacacaatcagcagcgtacgcgcgccggattcacccagccgtacggccagcgtgcacttaccatgctcacgatcctcgtcgatgtcacggatattgttcaccatcatgatcaggcaggagaacaggccagccgccacagcacccaatagtccgccgacgtccaccgtgccgcacagcgcgtattcggtgcccaataccgcagccaagccgaagaacaggaacacgccgacttctcccagcccgacgtatccatacggatgcttgccaccggtgtagaaccagccggccagcaaggaggccgcgcccacggcaaacagccaccaagcttgggaaatcacgatagcggcaatgccgcatatgcaggcgatggcggcgcaaatcaccgccgcgaacagtacatgcttggccggtaccagtccggatgcggtcagtcgctggggtttgcctgatttcgattcgtccgtgtcacgcccggcgtcagtgccgcggatgccatcggaatagtcgttcgcatagttgacggcgatttgcaggaacagcgcgactagcaggcacaggatggtcaccggccagaatcggtccatcagcagggtctgctgttcacgggccgtggcgcaggaggccggttcgggatatattgcgatgcaggtgcccgactgctcgatatgcgcgtatgccatcgtcgccccaaccatcaccgacgcgatggaagtggccaaggtcttgggacgcgcgccccgaacccacaagccgatggacataagcaacccctttcatatataactcggctcccctctctgaggggagccagagtatgcctaatcagccaacgagcggcttgaccagcgggaaggtgatggtctcgcgaatcgtggcaccggtcaaggcgataagcagtcgatcaatacccatacccataccgccggccggaggcatgcccacgccgagagcctcgaggaagtcctcatcgatgtcgcaagcctcttcgtcgccagcgagcgcgtccttggcctgagccacgaaacgttcacgctgcacgatcgggtcgttgagctcggagtagccggtagccagctcgaagccgcgcacgtagagatcccacttctccaccacgccgggcttggtgcggtggcccttgaccagcggggaggtttcgaccgggaagtcacgcacgaaggtgggctcgtaaagcttgtcctcgtagaagtgctcccacaggtgttcgacgagcttgccgtggttctccacgtcgtcgcgctctacgccgagcttgtcggcgatggcgcccaggtgctcaacggaggtgccgggggcgtccgggccgccgttcggcacaatctcctcgcccaacgattcggacagggagtcgtacatgctgatggtcttccattcgccgccgaagtcgtattcggtgccgtcgagcagggtgaccttgtgcgagccgtagacgtccatggcggtcttctgcacgagctccttgaccagctggccgatggaatcataggtgccataggcctggtaggcctcgaccatggtgaattcgggggcgtgcgtggcgtcgacgccctcattgcggaagtcacggttgatttcgaacacgcgatcgatgccgccgaccaggcagcgcttgaggaacagttccggggcgatgcgaaggtacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggagcggttgcgcaccatgttgcggatgttctcgtccgcgatcatgccgatgtacggcttgcgggtgcgggtgtcttcgttcaggtccttgtgcagggccggcagcggctgcagggccttagaggcgatagcccactcagtggcgaatacggacagctcgccggtcttggaggcgatgacgcggcccttgaggtacaagtgatcgccaaggtcgacgagctgcttgaactgcttgagcgaatcggcgccaatctccttcttggagatcatgccctgaatcttggtgccgtcaccggcggacagctgcacgaagcacaggccgcccgcgttgcgcaggaacagcacgcggccagcaatgccgaccatgtcttcggtctcttcgccagcctcgagcttgccgtcatacttggcgcggaccgcctcgatggtgtcggtgacgtccaagtgcaccgggtagggggcgatgccggcctcaagcatcatcgcgcgcttggccacgcgcatctgcacctgctcggggtgggccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcattctcagtgttttcggtattttcgacaacttcagccatgattcatcagtgtacgcaaggccggcgattatgagcccggcagaccgcacggccatctgaacacccgctcacatgacgcaaaaccggccctgcacaaggcttgagagacctgtacacatggcgaatccaccatcacgcaacactcgcgacatgccgatttgcattgtccaccaccacaatgtaatatctacatctgttgccaaacgggctgtagcgcagcttggtagcgcgcttcgttcgggacgaagaggccgcgggttcaaatcccgccagcccgacaactggaccggattgttgagaaatcagcaatccggtttttcgtttcctgtcccaacaatcaaaccaagcgatcgaacagcggtaaacaacccgccgcacacagcgacaaaccacatcacggcaagcccccgtatttgttggcggaccaccgtaatatatcgctcgaatcaatcgattgccgcactgtttttgtaagtaatactgaagtaattagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacactgattctggtattcggccgcaaggtgccgccgaaggacctcatcatattgtttatggtgattgccttggtgggcaatctggcttccgcattctccgtcaatgccgccatgctggtcgtcgcacgattcgtcgccggcctgccgcacggcgcattcttcggcacagccacactcatcgccaagactctggcggaggaaggcaaggaggcgcaggccgtatccgtgatggtcaccggacagaccgtggccaatatgctcggcgtaccggcgggcaccttgatggccgagttcctttcctggcgtcttgccttcggcattttggccgcttgggcggcaatgacgattgtgctggcgtcggcgtggattccgtacgttgcaccgatcaaggacgcaggcatcgccggtcagttcaagttcctcacccgccgtggcccgtgggtgattttggccgccgtgttcaccggcaatgccggtgtgttctgctggtggagctacgtctccccttggctgcagaaaaccggcggatggtcgtcttccctggtgccgatgctgatgatgcttgccggctttggtatggtcatcggcggtctgcttggaggtcgtctgaccgaccattggaggcatgccggcgcggccgcaataggtcagtccatctcctgcctcggcttgttgctggtgcttatcactccgggtaatcagccgatgaccgctgtactgacgttctggatcgccatcggattgttctttacttccgctccacagcaattgctgatgaccgaagccggccagggcggcggcgagctgatcgccggcgcggctgtacaggtggcgtttaacttcggcaatgccatcggctcgattgtcggcggcgcgatgctcaccaccttctcgatgaactatcgctataccggcctgggcggtatgccgctggctctgcttgccgtagggctgctggccttctactcgtggcgctgcgaaaccgataccgacgccattcaccgcttgcgcgaaaccaaggtggactgagaccaagctcacagcaaactccctgacgtgtttgttcacagtattaatagactgaaatcagacacgattcagggaggtctggcggtatggatgaggaagcactgctcaaacaattcgccgcgcaattcgcgcatggtccagacgatgccgacgacaccgatgcggcggccgcagcacaaggtgccgattccacggcgaaccaggttgcggacgatgccgatcaatcgcccgcaacctttgatacccaacaattcctgaacggactggacgcgattttcgatcgccacacggccgccaccgaagccggcccgtacttggaacaggcgatggtggacgcggaaaacgccggcgacgaggccggactgctcaccgtgctcaacgaaacgatgggcttctatcgctcgcaaggtcggcacaaggagaatcagtggattgtgcagcgagcgctggaactggccgctcgtatgggcttgaccaccggcacatccgaggcgtgggccaccacgctaatcaattgcgccacctcgatgcgcgcggccaaacaatacgatcaggccgaggatttgtatcatcaggcgcagagtgtctgccggcattcgctggcgcccaccgaccgtaggctcgcagcactgcacaacaatctgtcgatgctctacagcgagacgaatcggcccgacaaggcggaactggagttgcgtgaagcgctgcgcattatcgaagcctcgagcgtgaacccggacgcggatatcgacgtgtccagctcgcacacgaatctggcgttgaccctgctgaccgaacacaagttggaggacgcgcattggcatgcagccaaggcgctggaaatctatcgcaccggccatctggaacattccgcgcattatgcctccgcactggcgggcttcgcgcaggtgtgctttgccgagagacggtatgcggatgcggttactggataccggcatgcgctggccgtgatcgaggaatgttacggcaaggacaccgattactggcgtatcaccgccgacaatctgcggcaggccgaggaagcggcggcgcaggccggggtgacggttgacaatgcaggtgttgccggcgatgcaggcgcgctgccccagtccggctcgcggctgccgaacagcccggcacagggcaagaccggtgcgaacgcggcatcttccccatccaccgtttcggtgtcgaacggttctgcgggcgcggccgaggccgtttccgcatgcccggtgtccggactgaagctggcccgcgcgttctggacgcagatgggcaagccgatgattgcggcgaagtatccgcagtatgccgggcgtatcgccgccggtctggtgggccatggctcggaatgctacggattcgatgatacgtattcgcaggaccacgatttcggcccgcgcttctgcctgtggcttacggatgaggattacgcgaccatcggcgagcaacttgaggccgattacgaggcactgccgcgcaagttcagcgtggatgcgcaaggccgcgtgacgttcgaggcgcatgccaggtccgatgcttccggggcattcccctccgcaggtgcaggctccaccgtcatacccgatgcggcaaacgcacccacccccggtaccgctacggacgatgccgccactgccgagtcaggcgcggcgtcctctgatgtggcggaagcgatgacgactccgattgatgcaccgctctcccccgtcacgccgcgcgcacagggcgcgaatcgccgtgacggcgtgttccgcatcggtgacttctttgagtcgatcaccgggtatcacactgcgccggcgcagaccgcgccgcatgagtggctaatgcttcaggaatcgaccttggccgccgccaccaatggcgaggtgttcgccgatcccaccggtctgttttccaagacgcgccaagggttcaagaacatgcccgacgatgtgcggctcgcgctgatctccaagcgactcggcatgatcgcccaggccggtcaatataatctgccgcgttcgttgaagcgcggcgacggcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggatttggcgaaggcggcaagggcgcggctccagcaatcgagaaaatcaacgatattgtggagcagattgcggtggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgccacggcttcgccgtgccacctccctcatcagagggaggtatcagtgaaaggaacgtcgatgaccaacgaactgactgatgatgaactgcgcgaggctattgtgcgtcatgaatgggatcagttccagcgcaccaacaatgagggtggacgcgcggcatgccaaggcaactggccggtgttccaccagatgcggttggcccagttcctcacatgggagcggccattactcaccagctatgccgctgatcttgacgcggccgaccacgtgggccgcaacctcgtaaccgaaaaatacggccgcatgatggcctccaccgcaccggaaaatttcacgaagaacatagagccgtatattccgcgtctctctgaagagcgcgcggcccgtcaggaacaggtcatcgcccagcaggtcgcctgggccaaggatttccgcgagcgctaccccaagctcggcgaggcgatgcgcgcactcaccaccaccgaagacacaccatctgccacctcattcgaaacctatctgcgcggcgagcttggtacgtattccgaccagaccttcgaacgttacgaagcgatgattggcgagcgcgccgcagccagcccgcaacgcaatatcactgaggaaaccttgttgcacacagtccagctcggcggtttcgacaccttagaggaggccgaagcctcccaagcgtaatgctcagccattcactgtgtatcggacaccccgactgatgtacgtcggccggccatacccaggccaacgcaatctgccgatcgccccacacccagaccaccaacgcagcctgcccgccaggccccatttaccagcgcacatcggcagaattacagcgagaataggccccaaaatgccagtgtcatcagtgtggcgagagtgccgagcgctaccatcacgcatatgacgcgccgcacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgcgccgctgggcggcccccagctcactcggcgtcgcatgcacggcccgcacagtcgccacactacgtcgcccggccagcaacgtctgtagccaagaaaacacagtcaagccaatacctaatatcgccgccatcacgatcagcacgggccctgccaccatcagaccggccagcacgccaagcgagccgacgataccggatctggtacgttgcgacgcggcgaagcgctggtgaggtgttgcaccggcgacttgaggcgttgcccatccatcggctttggttccggcagtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtagcgatgatccgctgcgccccctgttcgatgggcatggccgtatcgtaggtgccgtagttcaccagcaccggcatggtgagggatttcagataccggtcggcatcaaagtcggcataggctagatcaaatggcgcgtagtccagcgacatcaatttggccatgtctttgaccacgggcttgggcgcgccggcctcatgcgtataggcgctgacagccatggccatttgctcacgtccattgaacaccggtgcggatgtaagtacggcaaaggcaatgtcttgccgtttcgaggttagaatcgtggcgatccaggtgccttcggattcggcgtagatgccggttttggcggggtccacgccgattctgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccactggtaccggacccgtgaatgaacagacaagccgggcgtggcccgggagcgccgaccggttcacgtagtacggcgggtagcgtgacgccgtcgccggtcttgatggatagtcgggtttcacgcgtacgatatcgcccctcgtggggaatgttcgcatgggcaggggtgatggtggtgtcggcagaagcgataacgatgtgcttggtgtagggccgtgtgttccattgcggcatcatcgcccagccaagtgtggcgaataccagcgtcatcgccatcgcggtgacgatgacgttcgccacccgccgcaccgaaatccgcttcatagttactatgcctccccccatcagcatagaacggtcggctcttatcggtcggctcccgtcataatgtgcttctactgggaccgtaatgcaatggtttgtaacgctattttctcttcttgacggcaccgactatggcccatacaacggccactattaccagaatcagtcccactacggcgcaaataatagccgtcagcaattgcggattcggcgagaacaacgaaatcatccgatccggagatatgtacccgaaaaccagcgcgatcacgccgataatcacgcctaatagtccgaataccacagtaggcgcgctggtgctctgtttctggatgttcttggcactcttgacatccttagcattctggacgttcttggcgctctggacgttcttggcgctccccccaggctggcatggtttgccggcggtctgagactgcccatagggaggtcgtgctgaagatgctgcgtacatcggcacatcatcggcagatggaatcggcccaccatctccctccacggcatcggcaactgtttccagggcaatccgatctgtggttggttcgatgggcgatggagaggcagctgttgcctgcgtatccacatccgagaccgacgcatccgcatgattgtcggggacgggcagcacagccgttttgtcatcatccgctgcggatggcagcaccgtggtatcggttcggtcatcgacggtcaccatggttgttgtcgcggtggtcgcgtcggtttcggaaggtatggccgtggtcggtgtcgcatcctcgagggaggcgaattccttggtttcatcagtcatgattccatctcctggttgtaacggcttgatcattccgattgttcggttgtgttcttgcttgtgctgttgccgtcgtatatatcggcaagcggctggaacgtggagcctccccaatcggaggcgtacaccacgttgacgcgtgcttccaccgcatagggaatattgatttttaattctgggccgttgtccggcatggcggattccttatacaaccattcgtgatcaggcccattggtggcactttcagcttcgaagaaaacaaagcttggacccatgtagttgttgtataccatctcgtatttgccgccaacgtcactcgaagtggagtagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggtccatgtgtcttgtcccaatcggaccaatcaatgattgcctgatcggtgttgtagttttcaccgctgaacgccacaccttgctgcaatgtttcaaacgtggcatcgctggcatcggcaacgaagatgccatccttttgcacatcgttcatgccgtcgctgtttctcgcactgacagattggctcagtgaaacaacagtattgatgccgctggcaccaagatcacggtagtacacgccatacgtgcctgaaacgatggtcatgcagagcgcgcatccaccggcaaccagtccgagaggaatcagaccaccggtacgccgtcctctgaatccgagaatgatgaccaccagccccatcactatgcatactgcggcaatccagatggtgcccagacgcataatgccgataatgcccatgtcgtttacccaaatcagtcccatcagaccggcaaaggagaggaaggtaaggcccagtatgctcaagaccacgattgggcccgccggcttgcggcgcttggactcggtgggggcataggccgtcgcattcatacggtcgggggcaaacggcccgttgggtactgtgccgggcatcgcgccgggcactgtgcctggcatcgcgctgggcatcgactgatagacaggctgtgaaacaggctgtgaaacactaggcgcggtttgtgaaacaggttgtgaaacaggttgtgaaacaggttgtggaaaaggttgcggagctgaatacaaaggagattgaggtactggttgcgcggctggatatgagacaggctgtggagctggatatgacacaggctgtgaaaccggtcgcggcgcagatgccccgaatccgtacccttcctgctggcgaatgccgcttttggccaacagccatagcgctaaggcggcgagcgcaatacaaccccaccccgcacctggaatcacgattgccacggcgaggaacaggaagcatcccagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactaatgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatatggattcgcgtttggattgctcatgattccattacaccgcccgaccactgccacaacgctcggggaacaccctgattgttccctgaacaccgggtaaaaccccggccgcaacgccctgagcgcggcacaataggagtatgacgtcatctcccgaaccattgctgcccgcgcgcatgccgttgatgcgcccccggcagggccgttggctcaccggcgtgtgcaagggcatcgccctgcacttgggcatcggcgtggcatgggttcggattgcgttcatcgcactgaccgtcctctacggcgcaggcatcatcgcttatgtattcctgtgggtgttcatgcctgccggagacccggtggcggctgcggctcgcacagtgcccgttgatcaggcgccgcttgcgcgaggcaatcagccacttgccgctcatgacgacgaatcggctgccgcaccggaatcattgtccgaggccatccaacgtgctccgaaaccggccgtcgtggcattggccggtttcgcgttgatggccactggactgttgctcaccagcaccggtgcggatgtccagattgtgtttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcacctctcctcgacgcattgttgccagcggattcgtgatgatcgtcggtatcgtggtggcggtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgaactccgaggaaccgaccaccgtattcgccctggcgcgtagccaagagcgcgagctgcgcgaatggctgtatcaggaacgttccacatcggatcgttcggtgggagccggattgaagcagatcgccgccgaggtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagggccggctggggcaccgaggtcagaatgcatatgccgatcgcgctgaaagcggcgcagggagaacatcgatgagcgagaacgagacagccaagattcgtgtggccatggtcgatgaccatgagatgttccgtgcgggcgtaatcgccacgttgcgcgattccttcgatatcgtcggccaagcggcggacgtgcccggttcggtggcgatgatcgcacagaccaagccgcaggtggtgttgctggatgtgcatgtgcccggcggcgagggtggcggcggtgccgagatcctcgccaaatcgcggccctactcccccactaccgtgtttctggcattgtcggtttcggatgcgccgcaggatgtggggtcggtgattcgcgccggcgcccagggctatgtaaccaagacgattaccggcgctgatttgatttcatccatcaagcaggtgcatgagggctatgccgtgttctcgccaaaactggccggttttgtactttcgaccttccagggtgtgccggcggcggggtctgatggcggcgctgatggtgcggcacgggctcatgatgaggagctggaccggctgtccgcccgcgagcaggaggtcatgcggctgatcgcgcgtggttacacatataaagaggtggcggccgaactgttcatttcgatcaagacggtcgaaacgcacgtgagctcggtgctgcgaaagcttcagctttcgaatcgcaccgagctcacccgctgggccgccgataggcgcatcgtgtgatgaaacgacaatgagctccctcatcagagggagctcatctgctcatatcactccgcgtcgcggaaaccgttggggttcttggtctgccagttgagggaggaggcggccatgtcgtcgatggtcagctcggccttccagccaagctccttctccgccttggaagcgtcggcgtagcaggcggcgatgtcaccggggcgacgcggcttgatcgcgtacggaatcggatgaccggcggccttctcgtaagccttgataacctcaagcacggagtagccgtggccagtacccaggttgtagacgaacacgccttccttgtcgatgtggtcaataacggccacgtgacccttggccaggtcgaccacgtggatgtagtcacgcacaccagtgccgtcgggcgtgtcgtagtcgtcgccgtagacctggacttccttgagctcgccgaccgcgaccttggccacgtacggggtgaggttcgccggaatacccttcggatcttcgcccagcaggccggactcgtgtgcgccgaccgggttgaagtagcgcagcagcacgatggtccaggacggatcggccacatgtacgtcgcgcagaatctgctcctggaacagcttggaggtgccgtacgggttggtggtgccgccggtcggcgtctcctcggtaatcggcagttccttcggcgtgccgtacacggtggcggaggaggagaagatgatcttcttgacgttgtgcttcttcatcaccttgagcagcacaagcgtggagtacaggttgttgtcgtagtattcgatcggcttggccacggactcgcccacggccttgagaccggcgaagtgaatgacccaatcgatgttgttttcggtgaagacgcgttccataagcgcctcatcgcgcacgtcaccgtcgtaacgcttgaccggcttgccggtgatctgctcgacgcgctcaagcgccacgggagacgagttgccgtagttatctacggaaataacgtcgtagcccttgtcgagcagttcgatgtcggtgtgggtggcgatgaatccagcaccgcccgtaaccagaacagtggtcatatctcctcctttggaaggacttgccttcggttttccttcagtattgagcttacttcacttgacctgtttcacctagcggcaaaaccaagactttcgaggaatgtttgcgtggtggctttctgcttgaagacggccgtgttgccgaggatgcggtagcagacgctgccgagctcgtcacgtacggcttggtggatggcctcgcggtcgcggtttccggccaatgtttcagcgagttcgccccattcgagactgaattcgctgactttatcgggcaaatcgcggccttcggcgagcgcctcctcgacgatgccgagctggtcgacgagccgtccgggcaggatgaacaggccttgggcttcgatcagtccaatcggctcctgcttgaccggccagtattcggggtgtgcatggaaaataccttccgggtactcgtcgctgatcgcattgttgcggaagatgagactcatctcatagccacgttcggtgatgatcgcgctgggcgagagggcggattggcggttgccgtccgcgtcatggctggcgatgccgttcgacgcgtcgtcataaccgacccatgcctcgcggatgatgtcggatacgtcgatgatgctctggcggtttttcgacaccacacgcacggcggtaccgggccagtcgaggatttcgaccacggcgtccggatagtcggcgagcgtgaaggcggcccaagtggcggccttgtgcatcggcagcagttcgccgccgccctggtagtggtcgtgggcgagcaccgagccgccgatgcgaggcagcgcggcgttgcatccgaggaagtatccggggaagcggtccacgaagtcgagcagatggccgaaagtgtcgcggtccacatgcatcggcgtgtggtcggtgttcacgcagatgccgtgctggtcgaagtagccgtagggcgagaactgccagaaccatgactcaccgccgagcgtgaccggcagggtgcgcagcgtgcgcttgtcacgtccggcgaagccctcgttctcatggcagatcgtgcacttcgggtagccgccggacacggcgttgccggccgccgccttcttcatgttcttgaattcgggtttggcgaggttgatggtcaccgtcagcccgtgcgagtcgaagcgctggttccggtcgagctgggcacgcttgacataattgttggccacacagtagtcgtagaaccattgcatggcggccatgccgccgtccctgtgctcgatgagcaggaaccggtcgtcgagatcggcggggttggcggagaggatgcccatgatggtgtcggcgtaggccgggccttcctccggatcgaagaggccggcggttgtggcggcggcgcggaaggcggcgagtagggggtcgggggtcttttcgtcagagggggcctggcttcggctgccgacaatgtcttggactgcgtctgacactgacgccgccgacgttgtggttttgggtccggggtaggaatccaggtggaagagggcgaagatttggttgcgggtccagtctgcgttgcgtggatcgaggtcgagatgatccaaggcgtaatcgactagggcgtcgatgctggcgtatacctcggtcagctgatcgctcattgctcggcccccatcatgctggttcgggtatggttcgactgacggctcacttggcagcctccatgatgtcggctacgatggcgtgggtttcactggccttctgctccatctcctgcacgagtttgatctgggtgcgggtgcgcaccagattgtgctcggggtacttggtggcaaagtagatatcgccttccaagtagtcggcgagaaagcgcatgccgcattccatggtgagcaggttgccgctgaacggcagcagttcggcctcgcgcgcggtgatgctgccacgtagttcgcccacgaatccttccgtgtaggcacggaacagctcggtgctgaaatgcaccttgctgaggtccttttcgtcttccagagcagtggacgcaccaaagcgtatggaatcgccgaagtcgaacagcatggagccgggcatgatggtgtcgagatcgatgatcgcacgcgccttgccggtggtggcgtccatgaggatgttgttgagcttggtgtcgttgtgggtcacgcgcaacggaatcgaaccgtccctgagcccatccatcacgacggcatactggtcggcgtggctcagatagaagtcgatttccggctggcatgcggcggcgcggccgagcttgtccgcggcgagggcggccttgaagtcctcgaaacgatgcggggtgtcgtggaagcgggcgatggtttcggtcagctggctggcgtcgaattcggacaggaagttctggaagtcgccgaatgcgctgccggcttcgcggaacacgtccgggttcggcacgaggttgtaggacacggtgtgttcgatgaacttgtagacgcgccatgcgccgccatcgatctcggcccaggtggcgcctgaggtggtgggcacaatgtccagcgtctctttgccctgagccttgagagtggaggtgaccagttcgacattgcgcatcagattcaccgtatcggggaagatgctggtgttcatctgctggaggatgtagcgggggccgtccgtggtcaccagataggtggtgttgatgtggccgtctccgtaaggttcgataccggtcacggcaccttccagcgcaaaatgcgaggcgatgccgaataaaacttcattgctttcagtcatgatgggtccgttctccaaaacgtgggatcaggcttcacgccaggcgataccgctgtcaggcaggtcgaagtcctcggtggtgccgtcggccaaagtcaccgtggtcttctgcggctgatcggtgttgttgattacgcaatacagcccttgctcggggaagtgcgccacctcgcactccggattggacgagctccaagccgcatacttgtcttcgttgtgggaggcgtagaacagcacgcgttccagcaggcgggcgttggccgccgaatagggcagaccggagatgtacacaccgcggccttcgccataatcattggtcgcgagctgcacctgcccgccgtccgcgcgcagcagggtcacgttttcattgaccggatacgtgttgagcacgggttcgccgaagtcgatgccgcccaacggcttgatggactggccaccgccgcaaccgctcagcgggatgcggtagccggcctgttcccaagcctcgcgggccgccgggtcgaccggcacatcggcggtgatgaagtggtccggcaccaccggtgggaagtacttgtccacggagagggtctgatagcgctcctcgtccacgccaatcacgtcggccagctggaagaaccggcccgcttggaagcgcggtgccgagctcggctcgcccacgcccacgaacgcgccgccaccacgcacccaggcgcgcacggtttccacgagcttcgggttggtccacacgtcgccgccggtgaatgcggtgtcgaccgggccgccgttgatgattacgtcgatatcactatcgatgccatgcgcgagtacgtcgtcgaagctgatgaaccgcacgttcacgcgcatgccggacagggattccagaatgccgtagtaggagtaggtctgcttgttgggcagggcgtgtgccacggtgaacgccatccaggaacgcatcttgccccaggaattcagaatcgccacgttgagctcgccttcggcggccaccccaccggtgcggtcgtggatgtcgcggaattcgtcggcgatatgggtcaccgtgtccacgaacttcgggaacttggcggccaaggagaggtagccaccgtagcccatacggccgatcggcgaacgcaggatcgcgcggcgggccttacgccagttgtcgaggccttcgatgctcgggtcgttgccctcgtagaacgtgtcggggaagaagtacggcaggaagcggccttcggtgtacttgacgcccggaatatcggcgatcatgcgggtggtggtgccgtcgccgatggaaccgaccacggcgtccaggccgagttcgtcgaatccgtccttgtacggttcggtgccgatccactggtcgccgaggaacatcatcgcctctttgccggcggcgtgggacatgtcggcgagctgcttgacgttttcgcgcacgaagccggagaggaagtcgatccagtcgcgctgggcttttctgggcacgcgccatgcggagttgtaggcaccgccgtccacgaagtcctccgggcgcaggcggtagccatacttggcttcgaaatcatccagcgcacgcgggcttacggtgcaggcgcaaccaaaccagtcgacgaccttttcgcggcgcttttcatcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaaactcaccgtgtactcatgccatgcggcaacgccgctcacatgcacggtgtcctcgtccgcgtcaagcgtccagttcgccgaatcaacgacctcgccggtggtgcggtctacaacctcccaatacttgtgagggtcggcatcacgattcggcttcagctgctcagcgaagaagctttccatcagcggaatatcaaccgtatccgattcggcgagaatgcgatcggtcagcagatacacctgtggcgtctcatccatatgcagcgtaatccactcgttatgcgcgcgagtcgggaaatacgcattgtaaatcttcttgcccaaggcaagcacagcctcatccagatgcgtgccatcggagttacgaatggcgtctgctccccacagttcggcaagctccttggtcttctccgcaaaattctcctcgctaggcaaggtgaagcggccggtgctagtcatagtctctcctttgaggacattgattatttttttggataattaaattgtaaacaatatatgcatataaaacaagaatccgacacaaccgtcgggcgtccaggatcctgactgtataaatccttgagagtagccccacggcaacgccggaagagcgaattgaacatcaccggagcttcccggtcagtttcaccgacaatctcatgacaagaatcaggaaggctctggatcggtatggttgcgtgctacttattgttgagaagccgtccggcgccggaaggagtagcacgaggcaccggacggcgggaattattggtcttaggctgtccgcttaacgcgtcgccttcggcccctgcaattaaggactcgcctacggcgagactcaatgctgccttcgctcggctaccgcctcgctcgggccgacgctacagacagcccaccgggctgtccgcttaacgcgtcagcccttgaccgcaccagcggcgaggccggcctgccagtagcgctggagaccgaggaagagcacgatcacaggcagcacaccgagcagagcacccatcatcagagcgccacgatcagtgaaggtagccagagagaccatgccgtacagacccaaggtcaccggcttcaaggtgtcggaagagaccatcatcaacggcagcaggaagttgttccaagtggccacgaacaggaacaggaagatcgtgaccattgccggagccagaatcctcaacacaatggtgaagaagatgcgagcttcgcttgcaccatcgatacgcgccgcctcaagcagctcgttcggcactgaggtctgcgcgtatacgcggcccaggaagaagccgaacggagagacgcagcacgggatgatgatggagagcatcgtgttggtcaggtgcatggcatggaagatggagtactgcggaatggtcagcagagcggccggcatcagcatgcagcccataatcacgccaatggcaaggttcttacccttgaagttgaactttgcggtagcgtatcccgccatcacagccacgagcgtacccaccagagcggaaacacccgagtagatcagggagttcagcacccagcgccagaactggccacgggtccaaccaatcagcgtgccatagttcttggcgatggcggcaggcaaatcgctcagacccacggcgaaccacagaccgttgctgccggtcatctggctcggcgtcttggtcgaggcgatgatggcccagtaaatcgggaacagaaagtagatcagcgcgaagaccagaacaacgatggtgatggtcttgaccagcgcggaaggctgcatggaacgaggcaggtcgttggcatgcttgtcgcgaatcctgtcagccttcttacgagcgcgtgcgaccgcgcgggattccttatcagtagcttctacggtgctcattctgcgttcaccttcctttcaacgagcgtgtagaccacggcgagtacgccagcgatcagtgccataacgatggccacagcggatgcaggtccgtcaccacccggggtcagcgtgccctgcgaggtattgagggccatcatcattggcgtgtacgacttggaaatgctcggatcggaaatcgacatcacctgcggctcgttgaacagctggatggtgccgacgatggagagcagcatggcaagcagggcggctgcacgcacgttcggcagcttgatcttcatggcgatctggaagccactggcgccatcgatgcgtgcggcctcgtacagatcgtgcggaatggcctgcagtgcggcgaggaagatcagcatgttgtagccggtgaaggtccaggtcgtgatgttggccatagagccgaggaccacattgtcgccgaagaagttcaccttgatgccgatggcggcaagtcccttaacgataggggaaatctggccgttgtagaggtacacccagatgatggatgcgaccacgcccggaatggcgtacggcaggaagtagctcagacggaatgcggtgatgtgcttgacgatataggaatcgatgagcattgccagagcaagtgccgcgatgatcatgaccggcacctgaatcacggtgtagagcactaccctgcccacgccagcccagaagttgccggaagtaataacgtattggaagttctgaagtccgacgaacttatcgaccagttccccgccgccgtatgcgccaccgcccgtggtgacctggcggaagaagctggaataaatagcccaaatgatgggaagaataaataccagagcgaacaggatgccaaacggtgccatgaaggcccagccggtacgattctcacgcttcacagcatcagaagcctttggcttatcggcacgcctggcgacccccgtcttcgccgtttttgttgttgcagtcatagggaaacctgtctttcaaaagaacagtgagaaatagaaagtacgtaatgcagttcgaatcgatgcagtcagatcaaacacaattaatgacgaaccgaactcgagtaaaaggaaaggccggagtgttgagctccggcctttcgatgtgtggttgaggatatcagcggctggaaggaaccctaaccgttaatgtcactcggaaacagacaagccgaagttcttcagcgtatccacagaggtggtctgtgcgtcggagaagatgtctgcaaccttgccggagccatcggtggccttggcggcggtttcgttcatcttggcggcgactgcggagaagccaggcatgtaggtgaagtcacccatgttgttgttagcggtcttgaattccttcatgatgtcctgaccaccgaagaaggtggaccactcggaaggagtctcagcgtcttcagtggtagcagccggcacgaggccctgggaaaccagatcaggaacctgggtgttgaaccaatccaggaactccattgcttccttcgggtgcttggagttcttcagcacggccacggcggaaccaccgtcagggccggtcttgccagcgttaccgaaccagtcaccgagctgagcgacctgccattcgccggagccggtgccaccggaggaggtcatgaacagcggggcttcccaagcggcggccacagtaccgatcaacgagccatccttgatggatgcatcgaaggacggatcccaacgcgggttggtggtggctgccttggcgtcgagcagctgctggtagaagtcagcggttgccttggagccatcggtctcggtgttgacgacccaggagtcgcccttcaccttgtaccaaccaccggaggcgccagccagaccggagatcatgttgccggcctcatcaggctggtaggacatgatgtacttgccagcggcggcagcggtcttggcagcggcgataaactcatcggcggtctgcggaatctcggtgatgccgagcttctcgaactcagccttgttgtagaagtaaaccagcgggccggtgtcctgcggcaggccgtaagccttgccgccaacctgaaccaggctgtacgggccggatgcgaagtcgttcttgtactgctcggcatactgggtcacatcctgcagcagacccttggtgaagacctcaggcagctcggcgtaaccgacctgagccagatccggagcctcgccggacttgacgtcggtctcaagcttcttgatcatgtcagaggccttaccatcgaacttggtggccttgacctgaatatccggatgctgcttattccacttggcaacgatgtcgttgaccagagtcatgccctcggaatccggcagacggtgcatgtaggtgatgttgaccacgccaccatcatcggtggtcttcgtgtcgccggcagtgtcgctgccgcaaccggccaagcccattcccattgctgctaccgcggcaaaagcagccacgatgcgcttattgcgagataccatatctctactccttcgtagtgaaatcatcatctcagtgtgatgactgattactaatgtatgccctcattcttttattgtcaacttagctaacaattaccgcgcgtcccgttgaggcgagtagcattaaaccggttcgatgctcgattgtgcgagtttgttcatttcattaactccccttacaaagcaacgtacttttggtccaccggtaggcctaatgagatattggatagcggcaacaatccaagacgttagcttgcaatcgtccaccgcaaattgcaagcacttgccaacattatcggttttcaggtcgccggcgcgatacccgaccagggggcaccgcaccttaatgagacgctacacgagcagtctcagcaactggtagagctgccacaggctacgcacgttgaagtgcgtgccgtcaaccgtggcgttcgcctcgccatcgcccatatggacgatcacggtgcgcccgttcacggtcagactaccgtgcatcgtgatatgattcatcttgcaaccttgttgattaaaggcgcaagccggtaatcaacgcaaaggcccgatgctgcaaacgtcgggccttttcttatcggctcacgccgatcggcccgtcatatcaacggggacaccgcatgttacggcatcacaaaccaatatatcagcaccccggcggcaatcaagaagacaggttccagaaaaagaaaaaaagggcctgggcatgttgcccaggcctcggttcgcggacagggcgagattcgaactcgcggagggttgcccctcaacggttttcaagaccgtctctttaggccgctcagacacctgtcctgatgcgcgttcacacgcgcaagtattcattatacagaagggagggatgttgatattcggcagtgcggtcggtcttggattcgcctgctggctatcagcgatctctccctcagtaatctctccctcagtcagctacgctgacagctccctcatcagagggagctaaagcacgatgagactcaggcctcccacttcgtgggctcgataacttccttgccgcccatgtaggcgcgcatggccttcgggatctcgatggagccgtccttctgctggtggttctccatgatggcgaccagccaacgggtggtggccaacgtgccgttcagggtggagaccgggcgggtgccgccgtcttccatacgctcgcggatgttcaggcggcgagcctggtactcggtgcagttcgaggtggaggtgagctcgcggtaacggccctgggtcggcacccaagcctcgcagtcgaacttacgggcggcggaggaaccgaggtcgccggcggcggtatcgatgatgcggtagggcacctcgaccttggcgagcatctcctgttccatggccagcaggtgctcgtgctccttgtaggagtcctcctgcttggcgtaaacgaacatctccaccttgtcgaactggtggacgcggatgatgccggaagtatccttgcctgcggcaccggcctcgcggcggtagcaggaggaccaaccgcagtagcgcagcgggccgttgccgaggtcgaggatctcgttctcgtgcatgccggcgagcgccacttcggaagtgccgaccaggtactggtcatcgggctcgcgcagacggtagatctcgtcggcgtgggagttcaggaagccggtgccgcgcatgacctcggggcgcacgagcgtcggggtgatggccagcgtgaagccgtgctcttcggcctggtccacggccatggtgagcatggcaatctgcatgcgggccacctggccacgcaggaaatagaagcgggagccgccgaccttgacgccgcggcgcatgtcgatgccggccacgccggtgccgagggtcaggtggtccttgggctcgaagccttcggccgcgaagtcgcgaatctggccaaccttcttgacgaccacgtagtcatcctcgccgccttcgggagcttcgggctccacgatgttggagagcttccacatggcggtggtgtattcctcggctgcggaatcggccttggacttgtattcggagaccttctgggacagttccttggtttcggcgatgagcttggccttctcgtccgccggggcggaggcgactttcttgccgatttccttctgctgggcgcgagcctcttcgaaggccttcagcgcctcacgacgtgcggtgtcggaggagagcacttcgtcgacgagttccacggactcgccgcgcttgcgctgggattccttgacgatatcggtgtgttcacggatgaattgaatatcaagcatgggcaccagactagccgcgtaagcagacaccgacaatggccgaatgcgcgggagtcacgcgcaagtcacgcggaaatcacagggaagcccgggaaagtccgtggacgggtccacccggccaatttcgtcagatgagacgcgattgaaccataatcacgccccacggggctgttgcgtgcaggaaatgttcacgtacggcgcaccatgggcgcaaacgacctccccaccgataacaataggagccatgcctcagcctgccctcaccgtgtttctgatcatcgccgcaatcgccattgtggcggtgctcatcgccgtcatcgtcatcgccctgcgcgcgcagcgccgccgcaagctggctcagacgctggagaagcgccgggacgacgaggtgcagtacgccttcatcgtgaatccgtccaaaccgcaggccgaagcccgcaggctgcatatccagaggttctgcgaggccaaggggctcaatcgcatccgcttctacgacacccagcttgacaaggacggcagggtctgcgcgcttgaggcgctggaggacggcgccgacgtggtgatcgcggtcggcggcgacggcacggtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccagattcccatgttctcgctgatgccggcggcatcctatgacgatggtctgctggacttcgaaatcatcgacaccaccggcggcatcctcggctgggccaacctgttcggcgacgtggtgcaccagacgatcatcggcaagcccgaacagaacccgctgtccacgaactcgaccatcgaacaggttcagggcgtcagtgccgaaatcacattggaaaagccggccaaagcgcaggtggacggcgacatgctaccggagaccaaacatattcgtttctcagtggatcatcgcgcgctgatcgtgcgcgtacccgacgcctccgcgctggaaaagaccgcacaggccgctgcctcaaacgccacctcggatttcgccgaaatgaccggcacgctcgagccgattcgctgatccgctacgatgcgtggccggtgactcgggcgacgtgcattgccagataggcggtttcgtcgtcgctgatatccgtgtcgaggcgcagttcgagcagggaggcgatggttcgcgcgcatcgtagcgcggcgggataggactcacgaatcaccttcatcaccggtgccggctcatccgtcagttgctggtgctggtggatgcgtacgaacaggtaacgcagatgggtgatgaacctgcccacattcacggaactgcggtccaacgtgatgccgtagctgtggtcgataatgtcaagcagttgctggatcacgcccgtcatcgtatacgtataggacaggtcgccggtggcgaagccggcgttgaccagatgcatggcaagcgcggtggcctcgccgtccggcagcgtgacgtcgagccgcgcattgagcgatgcgagcatcgcacgcccctgcgcgtattcctgcgggtacaggttgctcacctcgccgagcagcgggtaggtaatgtcgatgccgcgccgcacccgctccaccgcattcgccacgtgatccgacaaggccatgaccagcgtggtgctgccggtctcacgctcccccagtccggcttcctgcatggattcgacgaccacgcggatgatttcgggcggaatgtccgccagcatctgcgccagatggtccgggtcacgcccgtccgacggcacgaaggtgcgcacgactttcgactcgtcgaccgtctgccccggcttggcctggaaccccagtccacggccggtgagaatcacctcaccgccgtcgccgcctttggcgagcacgacgttgttgttgaacactcgcagtatttccatggcatcctttcgcaacgtcattgttccacatcgatgatcgggctgccgactgatacggttttgcagtcaccgccgttgttgtcgccgctaccgtcgccgatcaacggcgtgaccacggtcagttcagcggcgttgaccaccgtcaccaccaccacaacgctgtgcccggccgccgcgactttgccgaaatccacggtggccagtggctctcccgccgcgatccgctcgcctttagccacgaccacagcgaatccctcgccatccatatcgacggtgtcaatgccgatatgaaccagcacctcgatgccgccatcggttttaatgccgaaggcatggccggttcgggccacggttttcagcatgccactgaccggtgcgagcacggctgtctcaccggtcgtctccggcacgacgcctacgccctcccccagcgcgcgggaggcgaacaccggatcgccagtcgcttccagattcaccagccggccggcgaccggcgacaagatggcgttggagtcaagagcccgatcaggggcagcccgcgatggagaatcttccgcagactccacatccgacacggtcgtgtcaatccccctcgccatatcctgcgggcgtgcgttctcgtctgccgagaccatctgcgtcttggtggcgcgcgacggcgtgcggtacccgaacaacaccgtcaacaccatcgccattacaaacgcaacggcgatggacagcgcgtacacccacatccgatcgaacaccggaatcgtcagcaacgaggagaaggcgaatgccgtagtcgtaacgccccggaccatctggccggatggcagcacggacgggaacagccagccgaacaccgcgctggtcactccgccggccgcgcagccggcgagcagccagcggtagacgcggcggtgatgcagatggatgccgtacaggctcagttccgaaacgccacccagcaatcccgcgagcaacgcccccaccgcggtctgccgcatggccgaatccttgccgcgtacggccagcacgagcacgccggcggtggcaccgaagcaggcgaagttccatacacccatcggaccttggacgaagtcgtagccgagcgtctgaatgttcatcagtatcagggcgttcaacggccagtgcagaccgagcggcacgagaaacgggtagagcatcgggatgatgagcgcgaacaggaatggcacgtgcgcgttaagccatgctgtggccgctcccagcccgctgccgagccatattcccagaggcccgataaccagtatggtgagcgcaaaaacgacgaccagtgagaggaatggcacgaacaccagctgtacgctgtcgggaatgacgcgcttcagcccgcggtagaccacggcgagcacggcggccatgagcaatggtacgaagatgttgccactgtagtcgttgagttgaatcggtatgccgaacgccgacacggtgcaggtttcggcgccgaatacggcggtggccgagcattgaatctccccggagagagcgctggatacggacgtcccggacattccggacatcacgccagtaagctgcggggtcataagcgcggccataatcgcaccgccgagccaagggtcgacgtccagtttcttggccgcattgtaagcgatcataatcggcagaacggtgaacacaccctcccaaatcgccttgagtagtatccaaccggtggacgtctcgccatcaggcacaatgccgagtgcaacgatcacgttgacgatggcgatgaccagcgaggcaccgagtagcacgcccagaatcgggcggaacgagtcggacaggtagtcgaaaaacgcggcagcccgggcacgggcggcactgccccactcgcggatggtacgaggcatgaagtgacgggatgtattggctgggccgtgactctgctcggtgtcggtatcgcgcaatggtgcgacgtcgtcggaaaggttcggcgcggactgcgtaggctgcgtaggctgagtggattgcgttgactgagtggattgcgttgactgagtggattgcgttgactgagtggattgcgcggactgcgttggccgcgacgccgccgatggtaattgcgttgccggagtcaatcgcgctgcctgcatccgaacgatctgctcgtacaccgaggcgaccgctccgccgatgatgacctgataacgattgccggttcgcgggaatgcgccgaggactccggggatggattcgagaccgtgctggctgacctggccggcgtcgtccagttcgaagtgcagtcgcgtggcgcaatgggtcaggttggtgatgttcgcggagccgccgacggcatcaacgatgcacgccgcaatcactgcaggcgttgcgttcgatgcgttcgccacggttcctccttgctgccgtatgccactgtgttccattatcggcgctgggtgccccaaaagcacggcaatgccggcaaagcatcgcgaaacggcaactatgcgctacggtgctccgcgatagcgttccgctatggtgttccgccgcacccgttctccgtatttgccgcagcgcccattccgacttcattccaccatgcagaatcctgcaatcgttgtcaaaaatcatcgttttttgccgcctattcggagtgtcgcgaccgagaaagtcgtatcctatctttcacacacgttgcgtagcagggttgttactcaaaatgaggcaagacctggagtgacgtggaatttgcgtatcgtaatatgcgaattccacgttgttccaggtcttttttgttttcgggcgacttcaggcaatcgaagcctgaccttgcatgcggcagaggggccacgcggcaggcgcggcccgtcaacggcgaaaggacaaggcaatgacgacgacggcatcacccgtatcgaagcagacggcatccgcggcacaggagaccggcgcaaccggtgcagcggccaccgcaatcgaaaccatcgaaaccggcgtggccggggtggcggacgcggccacaaacgcggcagcaaacgcaatcgaggacctcgaagccgccgaatcacgcggcttctccacgcgcttcccgctcaacagcgcattcatcttcaccttcggcgcgctcggcggcatgctgttcggtttcgacaccggcattatctccggcgcctccccgcttatcgaatcagacttcggcctgagcgtctcccagaccggcttcatcacctcctcggtgctgatcggctcgtgcgcaggcgcgctgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggtctcgccgtcggcgcggcctccgccctgaccccggcgtacttggccgaactggcgccgaaggagcgtcgcggctcactgtccacgctgttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgttgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggtgtgcgcgaactgttccgtatcgctcgtccggcgctggtggccgccatcggtatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcatgctgatcttcggttccatcgtgatgaccgtttcgctcgcggtgctcgccgtgatgaacttcgtgggcgacgtggccgtgctggcagtgccgacgatgattctcatcgctttctatatcctcggctttgcggtctcgtggggcccgatcgcctgggtgcttatcggcgagatcttcccgctgagcgtgcgcggcatcggctcatccttcggctcggcggcgaactggctgggcaacttcatcgtctcccagttcttcctcgtgctgctcgatgcgttcggcaacaatgtgggcggcccgttcgcgattttcggcgtgttctcggccctgtccatcccgttcgtgctgcgcttggtgcccgagaccaagggcaagtcgctggaggaaatcgagaaggaaatgaccaagcgctagacaaccggcacacgattcgcacaaaagttgacaactcttaacataagagtacccaaagtggcgaaaaacgtggcagaatagggaacatggtagcaaacaatgcgggtcagcccgccaccccagcagatctgattaatgtcgatgaggttatcggcaagtactatgacctcgtccccgatcccgaagtccccgagcagcgtgtcatcttcggcacctccggtcaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtacgcgtcgattcccgtgacgacttcgtgcccaccccggtggtctcccaggccatcctgacccacaaccgtgcggccgacggcacccagcgcttcgagggcgagggcctcgccgacggcatcgtcgtcacgccgtcccacaacccgcccaccgacggtggcttcaagtacgaccccgtcaccggcggcccggctccggccgagaccaccaatgccatcgccgctcgcgccaacgagctgctcggcgacttcaagtccatcaagcgtgtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgatctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgcgtggagtacctgttcggcggcaaccgtccgggctggcctgagggcgcagccgtgggcaagacgctggtctcctcttccctgatcgaccgcgtggccgcatcgatcaacgcgaaggtcatcgaagtgccggtgggcttcaagtggttcgtggacccgctgttcagcggcgaagtcgccttcggcggcgaggagagctccggcatgagcttcctgcgcaaggatggccgcgtgtggaccaccgataaggatggtctgatccccgacctgctggccgccgagatcactgccaagaccggcaagaacccggcccagcttcaccaggagcaggtcgagcgcttcggcgagtcttggtacaagcgcgtcgacaccccgaccacactggagcagaaggccaagttcgcggcactgtccggcgacgacgtgaccgcctccaccctggctggcgaagacatcaccgccaagctgaccgaggcaccgggcaaccacgccaagatcggcggtctgaaggtcaccaccaaggacaactggttcgccgcccgcccctccggcaccgagaacatctacaaggtgtacgccgagtccttcgtctcccccgaggctctggacaaggtactcgacgaggccaccgtcgtggtcgacaaggccctgagcgagtgaaatcgctgcgttagtcgcgttcaccgcaactaataaggctctgcattggattcatgcaatccactgcagagcttttttagcgcatatgcagttcgcgaccactgaaacacgcaggtcaacggttctcctcatgcaccgtgactgcattttctcaacatcactgcagggcaggacggccagatgaccgcgaaacgttcgcctgcctaccatcatcattgtggggtcacagcggccagatgaccaccgaagcgttcggtcggcttgcatcatggtcgagttttaacatcgttgtgggacgccacgacgaatttgcccattccagagttgccatcccacaaaagcgtgggacaacagctaagtcaatcgttttacattttccccatcccacacactcaaactggaaaccccggaaagacgccattcctgccacacccgtcacagccattacccgaggggccgtgggacgccacgcaaaaatcggcaaaacacgcgtagcgtcccacacccattggcgcaaatccacgctcaatgcaccgacaacacccccaatcgaccactatgacacatttccctccacaatcgaacactagtcattcacgaaatccatcactacgaggcatcgcaatcgaacggcatgcaatatcaagcacacaccacaacaacaggtcgtacaaatattgcctttacatcagtccgtttcggacattatggtcacagcaggctctgcgacaactcttcaagagacatggcaactacatgaaactcgaatacggcaccgcgcgaagcaagcgccctcgccacgttgaaagcgaattcagcacgagcgtcctcgttagcgatacttgccgccgtggcgacgaagaccagccatctccgcccgaccagcacaccccttttctcttggtcacggcgccattgagccttactcgtacgatgatgatcgccatcatattcaacagcgaccttgaactctggccacgctaagtccaacgttatgggagctccagatgcaaaagccgcatccggcaccacatagttcgcaaccggctgtggaatcccatgcgctaccagagagagtcgttcttctgattctttgggcgaatcagcaccaggtgatatcagcggcaatgctcgaacgcaggacgggcgccctctgaatcgggtaaatcgctccacgaacttcaccagatcctgatagattgcagcagcatcacgatccttggccaatactggctgtttgctcgtagcagcgatgacggcatccccgagcacaatcagggactcaaaagaaacatacggggcaagttgggcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtttgcgctgggcgaggctttcgctcatggtcggtgtcgctgcagaatcatgtgcaccactgttcggcgatgacgagtcgcgagaagtcgggtatttcgagtcagtagaaaatgaccccgcaaattcgggcggaacaaaaactgcctccgattcttccggaggctgatcgtatatagagcctggcagagctccatagttggtgatgccgtcggtcatcctgttcatgacaccaccatatgggtagtgggtgcggaaacggaagccgatccgaggtatgtggtcctagcttcacttacgcacattcattgtggataaccatgtggacacctcacttatacacatagtcacccacctcttcaaccccgatttgacacactaactgtatctgatatgattacagtatcataactgtacacatcatagttacagtatcgactcggtaaggaggtcgtttcatgaacggcgaccattcactggcagtgcacgcattggtctaccttgaccatcgcgccacacacctgcccagtcagatcctggccgagaacatatgtaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtgaaagtgaactggacaccgggcgacgtacacgaggactgtctggtgtcatcttcaatgggcgcagtgatgaacgacatctatgccgggctcaaccgcacttgcctcgaacaactcgaacacaccaccatccacgacatcaccgaacagatattcagcgagcgcaaaggctaataatcccgcgcgtttcccctagccagcatcagtcgataacgcttcggcagtcaaagaagaaaacagacgccgcacggcacacaacacatcagcacaacgcactcttatcactcgaatacgtaaggaagtaaccatgtccatcagcacacccaatgccatcagcacacccaacacctcccccactatcaccaccgacgccctgatcattggattcggcaagggcggcaaaaccttggctgccaagctcagtgcagccggccgcaaggtcgtcgtcgccgaggcaagcgccgacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccgcgctcacttcaccggccctcatagcgtggaaatcgccaccgctgagggcccggtcgccgtgaccgccagcaagatcttcatcaataccggtgccacgccgcgcattccggatattcccggtatccgcactacgcccggcgtctacaccagcactggactgatggatctcgacgatatgccgcagcgactggtgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagttggaagcgcagggcgtcaagttcctgttcaacgcggataccaaggccatcgcgcctgctgctgacggcggcgtcaggttgtccgttgcggtgaagggtatgactcgcggcgcatcgcaagcttgcgattccacccccgccggcaccgggaacgctcataccgatatcaccggtgccaccggcgccaccgacactacaacaaccaccagccccactagcaacccgaccgatcacgccacgatgtcacacgttcaaacgaaaccatcagacgatggcgagccgcggttcgccgagccggctgaagcccgattctgcctgaccaccgacgcggtactggtggccaccggacgtacgccgaacgtcgagggactgcatcttgaggcggctggcgtggagctcaccgaacgcggtgccgtgaaagtcgacgagcttctgcgcaccacagcagccgacatttgggctctgggcgatgtgaacggcggcccgcagcacacgtacatttcgctggatgactatcgcgtggtgtggtcgcagctcaatggttccgaccgtccgtacacggtgaaggaccgcaagcatgtgccgtcgagcacattcctcgccacgccttactcgcgcgtgggattgaatgagcgcgaggcgaaggcggctggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatggtgttcacgcatccgacgattgccgaggcactgaacgacttgttcgcgtagtttgttcgcatagcacgcccgcgcagcatgacccgcgtagcgcagcccgcaacagactcccctaatgcgcgcgaaggtcctcatcgacgtaaaccgatgaggaccttcgcgctgtcgtcatgatccgtacgtgacagcaatcacgtccgaaccagccgttacttcaagccgagcttacggtccagaatgtcggaggcatccaatcctaagcggcgtcggatgaaccagccaagaccgagcggcaggccgggagccaaggccatgccgcctggaccgagtgccacggttttggagttgcctgcgataagcatggtgcccttggatgcggccgtggaggtcgaaccatcgctgtccgcctctggtttgaggatttcgatgttgccgtcactggttttgtacagtcccttattctcattccagataccggatgcgccattgttgccggcctcacccgcagagaggaagtgtcttgtttttcttgtgagcgctcacctattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagatgggtccgcattagggaatccaaacgggccaatgggctgggcctgggccgatcatgagcagaacgccggcggcaagcccggccataagcacgacgaccatggttatgatgcgggcggcgcgaccaacggcaccaatcagattggtgagctgtgcgcagtgctggaagctttgcgagcgcacccgggccctgagccattgctcatcgaatcggattcgcagtacgccatcaattgctcgaccaagtgggtcaaaggctggaagaagaacggctggaaaaattcgcagaaaaagcctgtgaagaacaaagagcttattcaggcgatcgaccgtgagatctcgcaacgccctggtccggtggatttccgatgggtcaaaggtcacgccggcaacgaaggcaatgagctggtcgatgaactggcacgcacctatgcgggcgattgccgttcgggtgcgcgcgacggctatctaccgattgaaggctggcagtcgctgctgggctccgaatacgcacatggcaccgatgtgcctccagacgtgcaattggtattggacggcaaagcggatgcggcaagtttgcgcaagccggctgcggcgacggatcagacggatgccgcaaggccggagaccaagtcttcgtcacacttagcggcacaatcaacgcaacctgtacaatcaacacaacctgtatcccccgcaaagcccagcgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcgtacgacactgacacccaaacacacgaatatgtaccgcaatcggacacgatgacacaaaatcgctcattcgcgttaggataggagataaggcttcacgccgttgatccgtgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacgtctcgccgcacgcaggcccaggccgagagctacggcatcaagatcgtggacatcgacgacgtggaccacatcgacgtgaccattgacggcgccgacgaagtcgacaagaacttcaacggcatcaagggcggcggcgctgctctgctgtgggagaagatcgtggccaccaactccaaccagatcgtgtggatcgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtgatcgtctcacatcactaagcttttccaagcccgcatctgcacatcgcaggtgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagagggaaccagtatgttgccgatagtccgcatatgccctgaacgcagttggggcatccacatcagcaatgtggatgccccaacgttcataagtttgtgcagcagctgacagccgatactagatgctacatcgggaacttctggtagaagcgatcgaccgcttccttggtgccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtactcctcgagcggcgacgcggaattccacgtcgtggaggcatccgccttggtacgcgcgtaattcagcacgctgcccggcatggccttcaacagctcactggcatcatccggcaaagctgtggcgtcgatggtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgcgtggtcgaggagttctcactattagtcatgccccgattctctcacagccgcgtgacgctaggcggccgtaattttagtcgttgtgcgcaagccgcgtgaaactcttgtgaacggtaaaaatttaccgtccgctggtgtttgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgcacggccgctcccggccgaacatcacgcacgcagtcggttacggttgccaacaacgccagatctgcagcccgtccgattaccgaagtgggcacggaaagcgtcgagcggctcggtaccgggttttccgaattcgaccgtgtgctcggcggtggcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttattcatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttcattgccgaggtcgcgggcgagcgcgcggatataggtgcccgatgaacagctgacccgcacgtcaatatcaagtgcgggaatcgttcccgtgttcgcgtcttcccgcaatggttcagcggcctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattgggtacttgttcgatatcgccggtgaaattggtggcgatggtgcgagtgagcaggttttgccatgaggcagttggtgacgccgttggttcgccgctctggccgccctcggtcagctgcgctgacagcgtttgccagcgggagcgggcttcatcatcgacaagcgcctcgccttcggcatcatcggtagtggtgcgcaggccgaggcgtatggtggcctcgtaggttttgtcatgcgccacgatggcgttgagcagtcgcgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggtgttgtatgaagcacactactcctcgtcagagtcgtcttcgaagtcgtcgctgggctcgtcgtcatgcttgtacggatcggcgtcgccggcgtactgggcggtggcgcgggcgcgggcgagttcttcgtcacgcttcttggccacggcgagtatgtcttcgatctcgtgagcctcgccgggcacttcatcgaacacgaattggagctgcggagtcaggcgcaggccagccttgtggcccaccagagaacgcaggtggcccttggcctgatcgagtgcctgctgggcgcgcttgcgttcgccttcctcgtggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggctgggggagagaaaatcatggaactaccatgtctctcccccagtcagtctgcggctgacagccccctcgtcagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgattgcaccgacgccgcggtggatgacctggatgccgacctcgtcggatacctcgatcttcatcaaggaatcctcgagcgcctcgaccgaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcgccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggcccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagtggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcagaagctcaaatgaccccttgcgagaaagcgatgacgttggcgggctacgccacccatccggctgaaggcacgccgttattagagcagtatgccaccggtctggccgctcccctggcttggattgacgttgccgggtattgttcgggtcgttttgccgagggaacgttacgtgacgcgcagaccaagcaatggctggcttttctggccgataaattcgggcagtccgcgcctgaggtgacgccggcgcgtcttgatggcgtcacgtccgccaacgttgatcgatcggtattggatgcgatggccgtggccgaggatcgcgccggattcgctatcgaggtcttggccgcacgaggacagaccgctggggctacgttggcgttgagcgatatgcataagaccgccgggcagcagttggttgcgctggcgaacggcaattttgatgattccggcgcacaatccagttcttccggccaaaacgacccccgccaaaaggtctatgccatcgaccaactactggccaaccccaccaccatcgccgacaaggcaagcggccaaaccgtaccgaccgccgccgccatcgaaatggactgcgcccgcgcgcagatcaaggccgtgaccgaatcgaaatcttccaccgagagcgatacgctgctcattctcgccgcactggccgccaagcacgcctacaccgcgttccaacttggctacccagcgactgacgccgcattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaattcaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggagatggattcaatgttgggcatggtgatccaatcgcttttcccgtaggccagatggtctccggtcgttacaatcggatatggctgctccagaacggccccttcatccgcgagcggcgacattacgaacagaatccatccttccgcccctaaacgataggactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgccgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggttttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcgatgggtcagacgatgagccgattaacagtccgaattggtcaactgcgaaaatccgaattcttcaactaccaaaatccgaatattggtggtggtagaagcggcggcggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctcccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgataccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttacacacgagccggcaaccggcatattctcgggataacaacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagctcctccatcgtcaggccgaagcgcgtgtacaggtcgatgcgttccagatatttgccgatgaagatgaacgccttcagcgtggggtcgaccggcgaattctcgatgccgccccagaaagcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaagttacggccgaccgcaccgaatcaggattggacccgtcgtacaggaagctgttcacgaacccgtcgaagtcctcgaaatcttcgggcaggtcgagtgcgtgagcgaacggacggaaggcgtccacatcggtgtccatcacacgatcgtagaacgggaagaactggttcagcgtggtgaaggcgcgctcggtgtatcgacccagccaatacaggttgtctgccttggaagcggtaaccagcgacaacgaatggtggcgggactggctcagcaggttcgccacctgcgtttcggcaccgtactcgtgctccacgccggattcgggtgccaacacccacgtatccttaaatccgccaccctgcgacgagttgacaatcatctggccgggcaccgacgagtatcgagtcaagcccgaataccacacgtgcgtattcttgccggtaaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtagaccacgcccacacggtggcgtttgccggcgtagtcgaggaagtagaccttgttgtccaccacttcgaggtcctcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcggcggtttaccagttcatgggccagtctgcgtgctgcggattcgatcatcgtgcctgctccttgctgtggcggcttctgtggcttcaagcggttaggcgtgttgagcgcacgctgacgccgcaagccgtaaccgggtttgatggtttcaacctaaggcgggcccgtttcaacaaacgcgcgagaatgttacaggcaggtcacttcgccggccgcgtgcatcttgacgaccgcactcgtctcgccgaccgcactcgttacaatgaatggctatgacacgactgcgcattgacttggcctacgacggcggcggattctatggctgggccaaacagcccaatcttcgtacagtgcaaggcaccattgaagatgcgctgcacaaggtgctgcgggtgccgaccgatgacgcggccgaaccgttacgcttgacagtggctggacgcaccgacaccggtgtacatgcctcccaccaagtggcgcatctggatgtatccgatgaggtactgaatcgctgcgtaggtcacatgaccattccggtcaccgaggcgctgactcgcagactcaaggctgtgctgccttcggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgatcacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccgggctaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtgatatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcgaggtcggcgagcatctcgtcgagagcggtgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgttccactcctcgcgcggccgcctgcccattgcgggcgaccgctgccaagcgggcgtcagccctctttgtggtccacgttttcgaacaggaagccggtgtactggaactgttcggtctgggccttggcctgacgcagggtgtcgaggcccacgcccgcgatgatcaggatcgtggtgccgccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccaggactggtcggacttgccgaactgggcgatcagggtcgggatggcgaggatcgaggaggcgaagatcggcgggatgacgccggacatgttgatcttcagcggcaggtaggtggaggagccgccgtacatcttacggccgatcatgcggcgcgtgtactgcaccgggacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggagccgtccgggatgacctggtcgcactggtagttgaacagggcgccggagcgggcggtgaccaggatggtggtggactggagcacggccaggccgatggtcaggtaacgggtgtactgggtgagcttggcctcgccggactggccctccttgtgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatggtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacggggggaagcatactcaaaacgatcattgtgttgagactgcttctctgcactcagaacaacaattttttagaaaagggacccccgtccacctattggcgggcgggggttgtacagcctattgcgctccccgtaggactaatcagtcctcggaaacggaaccgccggcggcctcgatcttggacttggcggaagccgaagccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacgaagcttcggcaggcgcatgtacagcggcagctggccgccttcaaagcccggacgcacgtggttgcgcttcgtctggcccttggcgccacgaccggcggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacacccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcagacaccagggtaatgcccttggtatcgtcgaccacctgagcaaccatgtgacggttggagcgggtgaccaccaggcgcggacgctcgggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcagcgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcgccgatggcctggccttcacgcaggtggaactgcgcgacggacttcttggccttggtgatcttcggcttctggccggtgatcagggtgaggtccttgacggcaccttcgatgagcttggagtcgcgggcagcggcaccaacacccatggagacgacgaccttctggacacgagcaacctgcatcgggttggagtacttgaactccttctcgagctcaggaatgatctgctcgttgtacttgaccttcaagcgcggggtggccggcgcctcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcgacgattagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcgcgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgatgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgggaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgaacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttgccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgacgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtgatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcagccagttcctggccggcctcgaactgatcgacgtcgtcggtgcgcacctcgacgaggtggcgacgcggggtgacaccggccttggcaaagtggccagccagcggcttggtcaccttggtgggatcgatggcgccgtagccgagctggacagccttgtagccgtcagattcctcggtcttcacagcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgctgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcaccgcgattcggaatatgccagatttgagccagatattcgaccttcacgcctggtggcccgcgggttcattgcccgtgagcgggctgattgccaccgtgctgtttgcgctgacgcagtatgggtcggttttggtggtcaaaaccatgatccgggaacgcgggaagtgttcatacgtggcggcttcgtgggtatggcatgtggcgctattgctgctagccgccgtgccgtctggacgcagtccgtatctgattgcgatgactgtgctgctgttggcccgcgccgttgcgttgccggtggttacacggcgcacaaccttgaagcccgtggtgaccggcattaccgaggcgtttgccagctttattgcttttggctgcataattgcggcgatttagcgacgcttcagcgattccatggggtggtaacccactcatggggcggtaattgacccatggggcggacggtaaaattttaccttccgcagaatagagccgtttttacaccgccccatggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagacactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtgcactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatatcctggtagcgttccggggcgatgtacttgttgtacttcggccaagaagtgggctcctcaggaatctggccgttgtaacgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttagagcgggcgcgcagctggtcgatgatcttgtcgacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcattgtagatgtcgccgatgccgccgagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagcggctcgtcgtcggagacttccttgcactcggcggccagaatggtggcgtcggccggaatctcgaagccagcagccttggcgatgaactgaggggacttgcccggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgcccacggtcttctggccggccagatagttggtgacgtgctcgcaggcgaagatgttcttggtggccttgtcttccacgagaccacggccggtctcgtcgacggccatcttggcgagaacgaggtgcttgttcagagcggcgatggatgccttggcgacgatacgatcaacttgcttctggtcgaggttctcgaattcgtcgagagccttcttggcgcgggcaaccagcgcgtcaacctcggcctcagctgcggcctgcttctcttctggggtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcacatgtgacctgagccacaatataccgaacggttcggcacgatgcacacgcacaaaatcgacggcgtttcacgtgcgatattgaacagtttttgttaagagttgtgcgaaatatcgaacaaattctcactttattcggcgatttggtactttttgttcactttttaccgaaaatcacatgcctgcaaacaacgcaatccgacaacttttttaaatcaagtttccaaaagtactcattttctccacatttctagaaaattggtttaaaaaagtacccaaatcgcctacaaatatacgatttttgtctcacaatctccgcgtcgaggcacatgaaagccactttcataaagtatacttgcatatatctcatcgcacaaaggggcaaatatgagggcaatgccatcaactgcagtgaaagcgcacaaccgcagtgccatgacccagtatctgtatggccatagccatgtcaccaagcaggaactggaacgcgagctcggcctcagcctgcccaccatcacccaaaatctgcgcgccctagaagatggcggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccctgacgccaccaccatcaccttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgtgtctatctggagcgacgcccaggcggcgcggtgattgtgggaggcaagctgtatcagggcccgaaccagtgcaatggcgccatcgaacatatgacgctggtaccgggcggtcgcgaatgctactgcggccagcgcggctgcatggacacctactgctcgccggagaccttgcccgaggattacgaaagtattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaaggcgcgcgtcatcgcacgcagcccgttcggcaccgaccatttcaatctgcgcaagagctactgcgccgaagaccagaacatcatcggtgccgcattgcgattcgccgagaattatctcgacgatatctgtggtgctgcggtacgcggctgatttccgcctaggcggcagcggtttcgggactcatggagacagtcatagaacaccaatcacggcaaaccggatgtcaccagccatggccaagcatacggccaccgcaagcacgaccattaccgcagtcactaccggccataccgaattatcattcattgctgcctccttggagccgatgcactttatgcgcatctaaccacttcgttgtattttcaagcctaaacggcagcattggccctatctgataccaagaaacccacttatggtactttcttgcacggatccgtgacaccgcccagaccggggcggcaatcaatgttctcggcgatattgagatggagtcataccggtttcttccagaaaccgacgattgaaattcgaggcattcgtatatccgctcaactgttgaatcttggcaatgggcatgtttgtgcaagtcagcaaacgacaagcacgccccactcgaagccgtcgaacaaaatcagcaaaaccgatgccggcaactcgcttgaagaagcgagaaaaggtggatacgctcatcgccgccgcatcagcggcaccttgcaagctgacctcatccagatgtgtggaaatataggtgatggcggcgttgatcccatcctccgcgccaaccgcaatctctggattgtattccggcgttaccacggtctggctttcctgcgctgatgcctgctcgaataccgtcagaatagcaataaggtcggcaacccgtctaactggactatgttctcccatggccactaatagctcgccggcctcacgtgccgaatcaccgaacaatacaagtgcatgctgcgaacggcgcaataccgtctcgaaaccggaagtctcgggaaaagcggcggtcaatagtcgcatagtctgcggacgtatatggcataacacatcacgatgagagagccgttctccaggaatgatatccgacaaccaattatgaggcagattggatccgatcatcgccacatgccccggcacgaatggcatgagtccatcccccgccatgagttgtccacttccctcacggataagatgaatttcgatttgtggatgataatgccatttggccagagagctcggatacccgtggcttgaccaacgtatggccgcatccccatcgggcacaatcacttccagcgagcccgcatccgaatgaggaatcgcagtcaagtttcgcgcatccatcgcagacctccttgtcaacgttgcgcagtacagctcgccatatttcgtactttaccgatggaacaactacggcgagatgattgcccgccggaatcctacggatatggcacataagtgcaggcggaaaaagggaaacgccaacatatgccgcaggatttcatcgggcaatcatctcgtcatcaacacgtcacagattagtctcgattgaccgtaatctgcaatttgatatcgcccggacgaccctcatccatacggtcgaaggcagccttggcgtccttcatggcaaacgtgtcagtgatgaacggcttcaggttaagtcggccgctatcgaccaaatcgatggctttctggtacacattggcgtaacggaagatgttctcaatacgcacttcggtggcctgcagctcggtcacgtcaatcggtaccgggttgaccggaataccgacgagcaccgcgcaaccgcccggggcaatcagcttccagaacgtctcataagctttcggcgcgccggaacactcgaatgccacatcagcgccccacccagcggtctcttcgcgtacacgttcaaccaagtcctccgtcgtcaaatccacggggataacgcccggaatctggccgataatacccagcttgatggaagacacatccgaaacaagcaccttggaagcgccaccggcgagcgcagcagaggcagtgagcatacccactgtgcccgagccggtcaccacgcacacatcgccgggcttgatgcgcgccttggtggcagcccacatgcccacggcggtcggctcaagcaacgcaccttcgccaaagctcatggaatcaggcagatggtaggtgaatgcggccgggtgaatgacctcctcacacaggcaaccgtcaatcggcggagtagcgaagaaacgcacagccggatcgacgttgtacatgcccagtcggctggcccgcgaagtcatatccggaatgcctggctcgagggcgactcggtcaccgggcttgaaatcagtgacgccggggccgacctccaacacggtgcccgctgcctcatggccgagaatcattggctgctcaacaacatacttgccaacacgaccgtgcgtgtagtaatgcaaatcagaaccgcatacgcccacggtgtggggtgcgatacgcagctcaccggggccgggatccttgacgtccgggacctcacgcacattgatgacgccctgctcttcgagaacaactgctttcatggtatttctccttatattggttgaatttttttgagggtcttgtattgttggtttttgacgagaacagtcagcgagcaccgctcagttcgccgccactttgcgggtgatgcccggctgctcggggcgaatccagaatgagatgaccgagccagagatgtagcaaatggcatatgcccagcacactccggcaaaacctacggtattgagcagtaccgtggcgatgaacggaccacagaatgtggtcaggcctgaagcgaggttatgtgcggaaaccgcagcgcccttgtgctcaggttccagagcagggaatactgcgcccatcggtacgaaagcggaaatacccatgccgagcaccacggcgcacacatacataaatggcaggttgtgcccaaacagctgcggcacatagtacatggcgagagtaccgagcgcggagagccagcagccccaccagcgcatctggctcatccagccgaagcaatcgcccatacggccccagaacacattgccgaatacggtgacgacgaacagcagaccccagatggtggaccattcggtgacctggtaccaagctccgccgccgtttgtatgcgtggcgagatacagcggcataatgaccggaaaaccgtacaaagtgagattgcaaatcacacgcaatacggcagcaagcgcaatctggtggttgtctttgagaatggtcacgccgcgagagagttcacgaagcttatccgaagagctcatcgtgtcaagattggcgttacgggttttcggcacaaaacacagacagataatcatgccgacaatcgagaacggcagtgacacccacagcgaatagtattcaccaatcaccggcgtgatgaacgccggcagataggcgccaaacacaccgatgccaaaggaataggaagtccagaaccagcccatggccgatgccagtttgccgggatccacagtttgcgcaagcaacactacgaagctgtagataaatagcggatagcccatgcctcgcaacatatacgacgccagcatcagcggataactgtggctaggcaatgccacaccgatgaataccagatgcagcacgatccaagaacccgcgccaataagcatgatgcgcttggctccgaacagttcggccagcacgcccgaggaccagccggcgagcgccgcgaccaatccgtacatcgtaaacagcagtgatgcctgcgacgagctgaatccctgatcgacgacatacttggacaaaaaggtcagttcaaacccatcgcctgtcatgaacactgcgatcgccaagaatcccggcagtagttttcgcgccagtccttgtgccatgaccgtctccttttactacgcaaacttcgttgttttcatccgcccaactttggagcgttaatacaagtttcgctgcgaaaatagcagtgttttggcgcgaaaacagtcaagaattgatactttcttgcatggatgttgttatgcccagcgtgctgctcattgttgtaacccagcacaatcatcaggcactaaaaaaacgaccggcgcatgtgcaccggtcgttgaatgttagttatcaggccagcccgtaataaaggctgagtattatattgcggccactatcgacacgcatattgcgcgcgaatcgggcgcatcggagccactactcctccacaatctggcagaattcgatggtctcgccgttggggccgtagatgttgaagtagcggatgccatgcttccagaaactcgggatggactggatctcggtgtccttgaagtccacgccgagcgccttggcgttctcgaaggcggcttcgatgtccggggtgtcgaaagcccagtggttgatggcgccggtggtcatcggggcggggtcgccttcccaggtttcaatggtcaggtggccgtagcgcaggaaggcgcaacggttctcgccattcatgaacagtccggcgagctcaaagcccataacctcgcggtagaacttgatggtctcatccaggtctttggcaatcatgccggaatgctggaggtcggtagtgaacgcggtcattggcttagccatgtgattctcctttgaatgtggtggttggataaaggttaaggatagtcggacaaggtatgcggcgcggcagaaccatgccgcactcctagtcaattctcgatactttcttgctgacgcaacatgatgttgcgatcagttcgcagtggcaaccatttcggcggccacggttacttcgggcagctaaacgtgcacggatgcgctgtcggtaggttccgaggactcggaggactctgcggatgcaacctttgcgcctttgatgcggtggcctttggcgtcgaagccgggctgctgcgggcggatgaacaaggtaagcacgaaggcgagcacgtataggccggcgtatgtccagcacacaccttcatagcccacaattggcagcaaaatggtggcgatgccagggccggcgaacgtggtcagaccggcggcgaggttgtatgcggacagcgccgcgccctgcttgccgcccgcgtacagggtcatgatggtgggcagcgacgagaacgcgcaggtgccgatgccgacgatgaccgaagcgacgatcatcataatggcattcgcgccgaaccactgcggaatgtagtagaacgccaccgagccgaccgcgagcaccgcgcagccgaaccagcgcatcggccatacccagccgaagcggtccatgaaccagccccagaacgtgttgaaaatcagcgtgatcacgaacacgaagccccagatacgcatccattcctcggttttgaagatgttgatgccgccattgtgggtggtgcacaggtacaacggcatgatgaccgggaacccgtagagcagcaggttattgatgatgcggatgatcgcgcagatgagcaccttgcgattggtgaccaggatggtggcaccctcggccagctcggcgagctgttccttgcggctcagtccttgcgatttgacgattttgttctttggtacgaagaagaagcacatgacggtgccgacgatggagaacggcagtgcgaaccagaaggtcttgtattcgccgaacaccggcatgatgaagctcggcaggtaagcgccaaacacgccaatgcccagagagaagcaggtccagaagaagccggtggcggaggccaggcgggcggggctgatgtattgcgccatcaggaccacgaagctgtagatgaacagcgggtagccgatgccgcgcaaggcgtacaggcccagaatcagcgaatacagaccactcgggatggcgaccccgagaaacagcaggtggatgccgatccaccagcaggcaccgaacatcatgatgcggcgggcaccgaacatttcggcgagcacgccggcgcaccagccgccgagggccgcgaacaggccgtacacagtgaccagcagggaggcctgcgaggacgagaagccttggtcgaccatgaatttggagaggaaggtgagctcgaatccatcgcccgtcatgaagatggcaacggcgaggaagccaagcagcaacacacggggaataccgaatttttcaaaaaagcgaatcatgggttgactccattaacatcgttgtcagtagaggtggtgcagggaaaaatgcggccgccggaagaaaaagggaaagccggcggccaagctatattggcggcgaaaaccgtgagacgaaacctcttccttccgctggcgggaggtggtgcgcagcaccggagggtggtaatacacgccgccggatgcctcccctcagtcggctccgccgccagctcccctcagggagaggagccggcaaagtgccgaaactactcgccgaccttgacgacggccttggagacgccctggatcttgccgtcgaggaagtcctggacttcttcgagtcccagttcgtggctgatgagcggtgcgacgttcatcttgccggattcgagcaggctgatggcgtctttgaaggtgagcgggttgatgaaggagccctgaatggtcagctgcttcttatagatatcgtaggtgttcatctcgaagtgcgcctcctgcgggcccacgccgaacatgagcacctgcgcgcccttcttggcggcggccacggcctgcgcctgggtggccggcaaacccacggcctcgatgatcacgtcataggattcggcaggaatggcctcgcgcgtggtgttgtagacgttcgtgacgccgaacagctcctggttgcgcttgagcttctcatcgaagatgccggccaggtccacctgatgcacgccgtaggcctgcacgatctgggcgaagagctggcccatgaagccgtctccgatgaccagcgctttctggtaggggcgcagcttcagcaggtccacgccgtgcacggcgcaggagataggttcgatggcggcggcgtccttcagcgagacgttgtccggcagtttgtagactacggtggccggtgcggtgaactgttcggccagaccgccgtcacgcgtgacgcccacggcggaaagatggtcgcacagttcggggcgctgggtcaggcagtactcgcactgaccgcagtagatgttcggatcgacggccacgcggtcgcccaccttgacaccagtgacctcggaaccgatggcggccacgacgccggagttctcatggccgagcacgatcggcggcacggcggcggccgaaccggggcggccggcgtacaggtcgtgatcggtgccacacacgccggcgtaggcggtgttgatcagtacttcgttgggctggatttcaggagtgggcaggtcctggatttcgaattccttgacgccggtgagcacaagagccttcatgatgggtcctttctacggtgaaagcgcgccactgcgatgagcaaggttgggccgggtgaccgggtggctgggcaaccaggtgaccggccggcaggcctatctgcatggcgattggtcgcgtattggtttcgttcatctcgctgtctttgcgaggtgttgatgaacagcataacttctttatctcagttttgcaaattatttttataaaactactttcattcggcgtgttgccttggaaatcaagggcttccaccaaaagtaacaacacgtctacaatggagttatgagaaatccaccgttgcatcgttacgccactcgcccagggctgtacttcactgacgacggtggtgctgacgtcgttgttcgttccgaaaccgccgatcaggtttggttgtgcgtgctggagcccattgatgagcccagcgctttcttccaagacgccatccgtctgttcgaggacccgaatatctcctttatccagcagattcatgagttcccggtgtgcacgcgcatcatcgaacatttgtatctgcgcgagaccctgtttcgcatgaccgggccgaactacggcctgtggtacgtgcacctgcccaaagcatgggacggcatgcgctatggctaccgcgtggacggcgcatgggacccgaaacatggcgtgcgcttcaatccatacaaattcctgcttgacccgtatggcaagggcatcgacggctccatggagctcacccccgccgccttctcctatgaatgcgatgtcgtggaccacaaggtaaccggttcggcatacggtgccatgagcaccgtagactcgctcggccatgtgccggtgtccgtggccatcgacgatcgcgatatccataagcatgagggcgacccgcagcacccgcatgtgccgtggcgcaaaaccgtcatctacgagatgcatgtcaaaggcttcaccgccaacgcgccgtggctgcccgaagcgttgcgcggcacctacgccggactcgcccaccccacaacgctcgcctatctgcagggattgggcatcacctccatcgaactgctgccgattatggccaagcaggacgagctcttcctgcaagaacacggccgcaagaactactggggctactccaccctcagctacttcgcccccgaaccctcctatgccaccaaagcagcccaagagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggctgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggtaacctgaagctcattatggagccgtgggatctgggcaacctcggctggcgcaccggccaattctccgtgccgttcgccgaatggaatgaccgcttccgcgacacggcccgcaccttctggcttgaggatgtggacggcggctccgatttcgggcgtatcagtttgcaggagatgtccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggcaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacactcactggacgcctaaatggtgctcggccgaaatcaacggccgtcgagccgggcatggcactcaggtcgaggaatgcgatttgaacggtgacaccaccgtctggacgcagcatgtaccggacgccagcgagacagtactcaagatggtcaaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacagcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacggttcttcggcagcatgcccttgacagcgttcttgatgatgcgctcggggttcttctcgagcagctcggcgtaggagtcacgacgcagaccaccgggacggccggagtgcgagtagagctccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccgggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgcggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcgtgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcacgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgccctcctcgccgttgggcgccccccacttgtcgtagcacaggcaccacgtggcatacgcctccaagtcggaaccacagtccgccttgaattggtcgaatacgctttggcgttcggcggtacggccggccttaaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattaatgagcacgaagtcggcaccggtcttctgcttggcgtccaccagcatggtcttcagatcctcgtaatcgcccacgccccaagagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccacataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcggccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagcggcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcgggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgcctatgggatggtcgctggatatcgggcaccattggtagttgccttgatgcacgttggcggtgggcacccaatcgatgcggttgacgcgccacgaccccttgacgcccttcttgccggcgaactggatgcgtgcggtcacaccctgattgttgaccaaggtttccggcgtgttcgccgactcggtgacggcgttgcccagaccgtagataatccacgtgccgttatagttctcgatgggctgcgcacaatggcaaccggcaccgtaaataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgtcgtgattcgggtcgccgtcttcgcgcagacgatccacctgccagtcctcgtcggcggtcatgccgttgagggagaccgtgccggtgaccagacccagcttgccgccgccggtcggggaatcgatgaccaacggtttggtggagtcggcttcggttttgtacgagccggtctgggcgatgccattggcctcaagcgtgtcccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcgggccttggaaatggctccacaatccctcatggaacaacaaatcgccgttgaccagcatggcgatgcagtccgtatccgggcaatccggtgaattgccgtgatgttcggtcaccggtttgggcgtgttcttcgctttattcaacgcgacgtccgacactccggcgtgtgcggggccattgccgtccgtgcgatgggttgcgaaccatgcgccgatgcccagcgcaacggcgagcacgatcacgaacacgataatcagcgccgcacggttggttcgtgtcgagttggagcgatgttgcccctgcccagcgatatggctcatctttgcccgcccttcggaactcttcttctctctctagggtaccgcccatctcggtcaagtactgcggggagggaggcgatgagcaagcgattggacaagcaatatataaaccggttaatcttcaatcaccattcacaaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcagcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacaggctgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggattttgtacggaacagttgcatagtgctcttcttttttctctgttgtttgcgcaccgaatgcgcacaataccgacaatcgagtatagaagagcccgcgtgtcttgtctattaataagactcagagtccgcaatatatgggattaataacccactccatcaatcaatagcgcgattacagcacaccgacgcagaccggttcgggcaccaagtccactccgaacgcgctcttgactgcctgctgaaccgcacgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcggcggacgtcttggtgccgggagtgccgtcaggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgagggaggccagacgctccagatcggtcaggatattggcctcgcgcttggcggtggccatgtcaggcaaggcgtagcgagtagggtcctcgagcatgcccttggcggcacgtactgcgagcacggctttgcggatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggccggccggccggccggggccggcgtacatgctggtcttcagtgcggagtatcgatagccgaatcgaagatcggcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacggcagaacgcccgcgaggggttcgttcagacgcgggatttctgccgtttctcacgcgatgcggatactgattccgcaccctactactcggctctggagtcaatacgcaaaaacccggccgaatgggccgggttttgtaaagctgtgatgcttgcgatcaacgagtctcgcggtgcacggtctgcttgccgcagcgcgggcagaacttcttgagctcaagacggtcgggcgtattacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataaccacagattttccaggtatgcaaatcagcccctacgcgaaccttgttttaccgcggaattatgcggttttatcggcgtgtctcacagcgtgttttcagggcccgcttcggccctgcaaacagccccgaccaaggctgcaccccgcacttcacccaatcattttttcttatatggtgctctagaaccttgcaatggcgcggttttcgagcgatgtcgcctgtttgcgcggcacggcgcatgctggcatgctgggcgcatggcttctgatcttgtacatcacggacaatcattcgacgaccagccgctcggattcggcacgctggccattcacctcggtaacggggtcgacgccgaaaccggcgcgatccgtcgccccatcacgctggcgaacgcctacgcgctgccctacgacgcctcggccttggcgattgccaagcatctcgaatcgctggatgtggtgcgtttcgtggcgtaccccggtctggaatcgcacctgcaccacgaggtggcggccagccagctggcccgcccggactccgggttcggcggcgtgctgtcgttcggcctcgacaccgaccacgacgggcacaaccgattcgtttccaagctcaatgtgattacgtctgccgtctcgctcggccatgaccaatcgctgatcgtgttcctcggtgaggatgacgagcgccagtacctgtacccgcctgagttccaccgcggcttcttccgtctggccgtgggtctggaggatacggacgatttgattcgcgacatcgatcacgcgctggcggaggccggattcgaggtgtgagaccgcaccgcgcgcatgatttcggcctcttccgccctgctgccgccgtcagtgagtcacaagatggctcggtgacgacgatggcagggcttttacgtcggcacaaggacaatacctggtggtctgccgacgatgacggcacttatcgtcggcagaccgccagtttttggaccgtcgccgacacagaacgccgatttgccgttggcaatggtccaaaaactggcccgataacgacaccaacgcggctcagcatcggcacatcgccatttcgtggcccactgccgacgctggcctcaggccacggcactcagcgtcggtagagagacaaccattggcacagcgcgacgacaccacgaacctgcgacacggaaaaaacaacataccgtcgacctactgccgtcttgtgcaaaatgtcttaagccgctcggccaagtcgccgactgagcctcttccatagggaccccaatccgttacccagtgtagatgcggtgcaacgccgaactcaactacgttgcgcgcatgcacctttatgcatagcaggcatggctgggcgtttggcgggagcggttttcggctcccctctctgaggggagcccctttccgcctggcaagagaaaaccccgactgtccgtgggaacagtcggggttgttgaagttcgctaggcgactaatcagccgaggatggcgagaatgtcgcgcgcgccgacgatgaggtagtcctcaccctcgtagtggacttcggtgccgccgtacttggagtacagcaccttgtcgccgaccttgacatccatcgggatgcgctcgcccttgtcgtcacgacggcccgggccaacggccaggacttcaccctgctgcggcttctccttggcgttgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgctcctcggattcgtggaatgcggctcgctgggcggcgtttgcagcctcgtcatcggcgtccgtatcggcatcatcgcgctgctccggctcagtgtctacagcgtttccggcgctgacagccttggcgtcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtaccgacgaactggggctttccgtccgggcgtgtcggagcggaattcttccggtcgacgcttatctggaaccggtggcggcgagtctggcagagaacccttgccccatatcttcagccaacagcgcaaatgttacgtggtcgcgccactggccattgacatacatataccgctcgcgcagtccctcatgatgggctccgaccttacgcactacagccaaagagcgcgcgttatccggaagaatggcgatttccagccgatgcaacgcgggcccgaatgggtctccgagtgcccaatcggcaagcatggccagtgccatcggcgcaaatccgtggccggcgtaccgttggtcgacccaatatccgaccacaccggtgcgcatggcaccatacgcgatggctcccaacgaaatctggccgacgatacgcatctggtattcgatggcgaaaatcacgccgacgccatgctgctcattacggcgctgtcgctgcacccattgattgaaggtgatggagccgccatgcatcgggtcgccggattcccaaggcgccagccagtcgttgttgcgccagcgcacttcgttccagccgtcctcatcgtccatggtcagggggcgcaggattatcgggaaaccgggatgggtgaggcgcggcggacggatctggtggtccagcttgaacgcctctttaatcgactggaaaactgacacggcctttattgtagccatatgaagggcttgcgccttcgcctcggccactttcgttttacggtggaaacactagattgtgcggtatgagcgaagcggacaatggcatgaatatcggcagcgaccacagcggcacggagaaaacagaaaagatggataaagcgacgctgcgccaccatatactgtctcggcgcaagcgcattccagcggaagaacgtggagcggccggtgaattgctggtgcgacggttcccggcacacatgattcaggatggttccacagtggcggcatatgtgtcgatgggttcggaaatcgaaacccggccactgttgcgatggctgttggctcatggctgccacgtgttggtgccacgattgggatctgggttggaaattggctggagtgtgctggattcattggaatccttgcgctcgatggatgcagtgggtggcgcgaacaatgccggtagctgcagctatcccagcaccgtccatcacagacccgatgagccaactggcgcagttctaccgcccgaagcgttggagaaggccgatctggtcatcgccccggctttggcagtggacccgcaaggcaatcgtctggggcgtggagccggctggtatgaccgggccttggctcgacgcaagcccgcgtgccccctgattgcggtgtgctggccgtgggaggtgttggacaccgatttgccggccgaaccacatgatgtgccggccgacggagtgctgacgccggggggataccggcggcttggcgaatcgggccggctgagttgaccggccggccaagatactcggcgcaagccagactgaccaaccagccacgcacactggccgatggaaccagagtggcaaaagcaggctggctagtaagaccgtaacgccaatgtgtcagggcggcgactaggatatgaacggttgcacggcatggtgttgcacgccatgcgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggattctaccgcaccgacaaatccggcaagtaaggtcggctccccgtttttcctctgtaaacgacggtgtcgacggcggtatgccgcggatattggcactacgggcactgtctgttacacgggtttgaagcgttgtggataacttggcaagctagaaccacataggtcgattcagcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgttgtttgggcttgaagccgtattggccgtggtggagaccgagccgatggtggtggccgctcgctcgattcgacggggtgacattattctggccgccgacgttcagttggctgatatgccggtatctgcgataggcccgtcttgggcgtgcaatattgaggatgtggtgggcaaggtggcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggtgccgattgcacgctggccgagaacgccacggtgatgaatgtcgacaaaccggatacgactggcgcattgggaagcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagcctgtcggctgcggaaaacacagtgttggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggttcacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggactggtgcagtcgttcttcgtccaaatcttcggaaccaaaggccgacacaatatccaagctgtggtccgccaatgccagggcatccagcaacagtccgcgaccgcctgtgctttcgagcgggccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagatggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcatcggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcgttgcccccgtgcaggtcgcccagatagcgggtcaagcgcgagcgcacgcccacgagttcgtcggccagctggtcgaatcgctgggtggcgactccgggctggaatccgactgcggcaatcagctgcttatcaagcgcggcgttggcgtgttcatcggatacatccagtacctgcgccttcatctcattggcggaagccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccattggcagcaagtgacgcggcatatcgcaccgtattgtccacatcgccgacttcgtactcggcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggccacgcgaccggtgaatcgaatggtggtcgacaagccatcaccctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatactgcggtattggtcacgccagcgacggatgcgattcagaccttccgtgagattctggttctgagtctggctctgggtcatctctcgactcactttccaaccgcttcgcggtattcctgatagcccttgttgtgagacaaggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgtggagtcgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccaccacatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcccggaccgaggccgtgccattgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcggcagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagtccggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtcccctgagttgttccgaattattctggcagtcagtctactcccggacccgttcacgttgcctccacaagctataatcggccacggttctgattgggtgcgcagcgcctgacgcgcgttgggcaggccgatcagggcgagtcgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaactttaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcacccgagagaagctagagaacgatcagtcctcgaatgccgaaccgttaagcgggaagccctacgggcttcccgtaggtgagggagcggctatgccgcgaccgatccgtgagagggctttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcatcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcagtgccgggggtgaggttcacgaaagcgccgaacgacgtggtcttgacgaccttgccgttgtaggtttcgccggcctcgggcacgtgcgggttggcaatctggtcgatgatggccttggccttctcagcagcctcgccaccctcggaggagatgaagacggtaccgtcatcctcgatggcaatttcagcgccggtgtcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgagcttccttggcctgctgcaaagcggcggccagaatgtcagcggggatgccgtcgagcttggtgtcgagctgcagggcggtgatgaactcggaagtgccggccaccttgaagtccatgtcgccgaaggcatcctcggcacccagaatatcggtgagggtcttgaagatgtgcttgccatcaacgtcgccggacacgaggcccatggcgatgccggcaaccggagccttcagcggcacgccggcagccaaaaggctcagcgtggaggcgcacacggaacccatcgaagtggaaccgttggaaccgatggcctcggagacctggcggatggcgtaggggaactcttcgcggctcggcagcaccggcacgagagccttctcggcgagggcgccgtgaccgatttcgcggcgcttcggggaaccgacgcggccggtctcaccagtggagtacggcggcatctcgtagttgtgcatgtaacgcttggactgcggaccggacagcgcgtcgatctgctgctccatcttgagcatgttcagggtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacgatctggcgctgcagttccttgaaggcgttaccgagttccttgtccttctcggcatcgtccatatcagtgaactcgtccgcgagcacctcgcgcacgtgctccttgatctcgtggatgcggtcctggcgcggcagcttctcggcgatggagagggcctcgtccagatccttgtgagcgatctcgtcgatgcgggcgtacagctcgtcggtgtactccgggaagagctggaattccttggtctccttggcggcgatcttcttgagctcgtcctgagcctcgcaaatcaccttgatgaacggcttggcggcctcaagaccaccggcaacgacttcctcatcgggcttggtctgaccctcgtcgtagatgaggtgccaggcgttcttgccggcaccggcctcgatcatggcgatggcaacatcaccgttctcgatcacgcggccagcgaccacaatctcgaacacggcgcgctcacgctcgctccaacgcgggaaggcaacccactggccatcaatcagcgccagacgcacaccggagaccgggccttcgaacggcagaccggaaatcatggtggaagcggaagcggcgttcagggcgatgacatcgtaagcgtcatcagggttcacggcgagcacggtctcgacgacctgcacttcgttgcgcagggtgtgcgggaacagcggacgcagcgggcggtcgatgatacggcaggcgaggatggcctcggagctcgggcggccttcacgacggaagaacgagcccgggatcttgccggcagcgtacatcttctcttcaacatcgacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttgccaaacgatccattgtcgattacggcctcaacggccttgatttcgggaccctccatagggttcctccttctttaattttctatttattcctacatactgtgttgcggtttggcgactcgcttgaaccgcaactgtcctcttcagcggacgtcacataccttgtttcgactgaccccttggccgtcgttcctcgtgtcaaccccttcattcgggttctcctgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacgtcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatactttttggcttcgtatttggagccatcaagcaaatcagtggtgcgcagcagcatcaccgtacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaacctttcatgataagcactcaacatcgagtgcgtattccaatagcatgcccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatccgtgtcatcaacggcatcggaagcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggccggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatggcctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactcccccccccccatcattttttcttcgccgcacaatcgaatcccacgttggttacgaccacatcgcggctcattgcaaagccatgccagaggaacgtccctcaagggcagccatgcaacagccattatataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagcctcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctagggttggaagtgttcagtttctaacttaagaaggtgttgcactcatgggtcaacagtattcgcacctgtccgccacggtcttcgtttcggtggcttctggtcacctgaccctccttgcggtaggtcaggtgttgcaacgatcactagaacccgccatacgcgcggcgcttcgaggagggggccacggtgctcgatgcggatccgcagtccagcgcgagcctgtggagggacatggccgaggaaaacggcgggtggcccgcaggcaccgatgtgatgccggcgaacctgagcacgctccagcagctggcccgtgccgggcatggcggcttcgctgtggtggacgcgccgccgcagggccggctgttcgaggaaagcgtcaaggccgccgacttcgtggtcgtgcccacctccgattcgcccattgatctgcagcaggcgtgggcgacgatgaacgcgattcccgatggcaagcccggtgcggtgctcatcgtgcgcgccgaaccccgcacccgagccttccaggcgaccgtcgccgctcttgacgaggccggcacgccccgtttcgacgccgttgtgtacaagcggcaggacatcaaggccggcatggggcactcccccgacaagctccacgagtacccccaggtgctcggcgagatcgtcgaagcgatgggggcgcgcgcatgaggaacctcgacatggctttcaggcccgcagcccgcacccgcagcgtctccggcatggccgacgtcttccgctccgatcagacgggggaatggtccaagaccagcgtgagcatgaggcccgaaacgcggcggcggctcaagacctacgccgccgcgcacgacatgcgcatccaggaggtcatcgacctcgcgctcgaagcctatctcgcatgacgcgagacgccgtgcgaaacaagcaggtgcccgaaccggaacggtgcagagcgccaccggcggcggcatgaacgcgcggaaaccggcaaccccggctccgacagagaatgaccgaaataccgaaaccggtaaaatcggtgcataccgaaacgaacgatgaaaggacacgaatgaaaacggaacaggaaacggaaaccaacaccccgccgcccacgaacggagaaaccgccgccgtcgaggagtcgaggcgtgttcggccgaagtggctggtgccgctggtcgcgggcctgtgcgcgctggcgcttgtggtggccggcggcatcggatggaaaatatggtcggaccgccgactgtccgaggcgaaggccgcgtgcgccacggcctccgacgcggcgcgcggcgcgatgaacgactggaacacgctcgtcaacggcgacgcggccgacttgctggaggtcaaggccgatcaggtgaaggacgcgaagaccatcgacgcgctgaaaaccgcgctggacgtggaagcgccggaatacgagggctgcgtggccgacggcaaggacgggcttgaaacggcgatcgacgaactggacgatgcggccgcatggtacgagaagcacgccgggagcctgaagaaggcggtggacgcggtgaacgactcgaagctggcgaagaccatcgacacggcgaaaaccctgttggagtccagcaacggcaacgtgcaggatgacaagacgcgcgaggaactgtccaaggccatcgaagccaaggacgaggccgcgatagccaaggcatccaaggcggtgaacgattccatcgcggcgaagcagaaggccgacgaggaggcgaaagccaaggcccaggccgaggccgatgcgaaagccgccgccgctgcgaacgcccagacgcaacaacagcagtacaactatcagcagtctcagccccagcaatcctggacaccctcatacccctacggcggaggcgccactggtggcggaagcggcaccacgggaggttccacaggcggctccgccggttcctcctacggcgggagcttcggctacagcagcggctatggagctgctactccgggcggaacttgcccggagagcgtgtgcggcgtctgacttgctgacatgcaggcatgaaactcgtccgattcgttcgggcgagtttttttatcattcgcttcggtatgcaccgattttaccggtttcggtatttcggtagataccccgaatcatgcgttttaggcgtttcccttcctcgtggtcaatatctcgcgtaactgatcggaaaaaatgtccaaactggaccggccgaaatggggttctaatggtttgtggccggagttttccggactccggctaccggcttttaggccggtcggaaacaagaatctaacaggaggaaaccctatggttttcaacgagaggaaacgggctgatgcccgcaacgggaaggggctgcgcgtggcagtggccgctttgactgcggtggcgacgctggcaggcggcggcatggtcgcggccaccgcgatggccgacggcggcggcggctgggctcccggctcggctggcagtgtcggcggctcggtgatcggctgggcctatgaggacaacaacaacggcggtttcggcggcgctacccttgacgcgttcaagaaggccgtggcgaagatgggcgcgacctataacaactacaacggcgtggccgatgagaaggcgaacaccgcgatcacgatggccaacaatgaatgcgtggcccgtttcaacgataagcatccgggcgagaccgcgaactgccgcatggtcgccgtcggcgtggtcgccacgcccaccacgcactcctattccggcgaaggcttcgccgacgccccctattggagcgacgcatggaacaaaaacatcgcaccggttaaataccacaataatggtgcgtcttatgacactgacgacggtttctctgatgctcctgagcgttcggtggactcgatcgcggcctcccagtggaataacagcccggttgcgatcgtcatcatgttgaaccaatacgagccggtgcagccgaactatcacttgagcgtgagcacgcaggctgcggagatgtcgggccagtcgggcgacaccaaggacgcttcggacacaatcaccctgtccagcgacgggtcgaagaccgagaacgtgaacggcaccgcgaccctgcactggcgcggcatcgacggcaccgagaagacggtggcgaagcagttcaccgcatccaacaagggcaacgccacagtgagcgcgtccttcaaggacatggacgcctcgtgggagtcgtggcctgcgggcaagcgctggtgggacgttgacgtggcgaagcagggcaacatggccgaggcggtctcccacaagggagagaacgacggcaaggagtccggcgagaagaccaccaccccgcccgagaaatggctgaccaacgaggccggcgacacggtgcgggacggcaacgactccatcgcgtccggctcgctgtacaccgcgcacatcaaggcgcattccaacgcctccggcaagttctggatctacgacacgatcaacaccagggacgtggtgatcggcggcaccgagcaggacgacgtgagcaaggtgaccgtgaccgacgcgaacggcaacatcgtgccggcggacatttccatcgacgattccatcgatggcaagcgcgtggtcaaggcgcacgccaccgccccgcattccggcctctacacgctgaacgtgccacagtcggccaagcccaccggcggcgactacaagatcaacgacggttccgtggcgtgctggaacggcgacaacggcaccggcagcctggccgactgccagaccggcaacagcgacagcgtgggcaaggtcacgccgaccccggacaaggtgtgggtgctggacgagtccggcgctctcgtggccgaggacaagcaatggaccaaccagcagggcgtcgatcagaagacgttcctcgtgggcgaccaggtgggcgtggtcgtcaacggcagcatccccgcgcacctgctcaacccgctggcatcctattccatcaccgatgatctgaccggttcgaaccagtggatcgactggaagtccggcaaggtgttcgttgacggcaaggacgagaccgaccagttcgatatcgtgatcgaccggaaggccgggaccgcgaccgccaccgcgaagtccgcctacatcgcgaagacgatgttcaagaacagcgcgagcaaggtcaagttctacctgacgggcaccatcaaaaagggtgccaccgagggcaggaagatccagctgaccaacaaggcgtacgagaagtggaacaacgagacccgaccgaccaacgagcccccggtgttcgtgtggacacccaaccccaacaaggcgtgggccatgaaggtcggcggcaagtggcagctgaccgtcgatccgaccaaaagcgacaaggtgggcggcgacgacaagtactaccgtctcggcgacgaggtggcggcggtcatctccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccggcgtcaacgacctgaacaagaccggcaaggacgtgaccgaccagttcgacatcaccgccgagggcaccaaggtcacggtcagcgcgaaggactcctacgaggccgcgcagaaggacctgaagaccgcgaagcagatcagcgtcgtgatccccttcgacgtgaacttcgacaccaagcagctgctcgaatcctacggcaaggcggagggcgacgagctcaacacgtgcgttgacccgaagggcgacgacctcgacaacaagggcggccagacggtcggcggcagcacggtggacaccaacacgccgaagatctgcgtgaccgtgcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccaccgcgaacaagcaaaccctggagatcaccgacctgggaaccggcggcatcatcccgaagagcgcctacaaggtgcagtgggacgaagccaaccactcgttcgaggccacgttcaccaaggactgggttgccgccaactggaaggccggctccaacccgcgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatgacggacgactacgaccaggagtacctgaccctcgacgcgaagcacgtggagatccttgacgagaccggcagggaccgcaccggcgagttcaacatccaggacaaggacggcgtgctctacgccttcgccaggaccgttgacaccatgatccccgcgaccggcgagaccgtgcccggcgacccgcaacccgacgacctgaaggcctacagcgagaaaaccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaggcgcgacaagaccaacaccgtcaccaacccgctgaaggagatcaacccgaagaaggacgtgaccgtgcaggtcggcggcgacagcatcgacggcaagagcgtgtatctgaaccacacgttcctctaccgcctggattccagcatcctgcccccggaccgcgcctaccagaccgtcacggactggggcggcacggaccagctgaacaccgagtacgaccagtacctgggcaactgggccgtctacgcctcgcgtgatttgtacagggacggccaggtgctcgcggccaggggcgagaagatcgcgggcagcggcttcgactcctcgaagttcggcggcaacctgttcaccgtggacgccgacggcaacggcaaggtcacggccgacgcgacccaggcctacctcgacctggtgagcgccgacaacgagcacgaggccggctggaggctctatctccagtgcaagcgcatcgccgtggccgacgaggtgcccaacacgtggaccgagaccatcaacggccagccgcgcgaatccaacaaggtcgtcaccaagaccccggacatgaccccgagcatccacctggagaaggtcgataccccgaccctcaagcaggacggccaggagcgggcggaccgcgacgacccgaagcaggcgctgaagatggacgccgacagcatcggcatcacgttcatcatcacgaacacctccaagaccgacccggccaccggcgacggcgcatggtacaaggcaagcgacctgaacctcgccgactccaccatcgtcggcgacgcgcacgtggacatggattcgctcgcctaccccgacaactgggacaccctggtgctcaagccgggcgagtcggtcagcgtgaccggcacgctcaagggcgtcagggaaggcgatacccacacggaccgcgccatcgtcaccggcaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccaccagcaacaccgacgactggaacggctaccgtgccaagccgttggcctccaccggcacggccgtgctcggccttgccggcggcgccctggcggtgctgcttgccggcggctccctgctcgtgttccgcaagcgccaccgcgcacagggttccggccgccacacggccgtgaacgcgggcaagtgaccccgaggcgttccggcctcgtcgtccgatgacggccggaacgccctccattgacttcacatgaatgaaccacagacttcgccctccccgacgaatcaccgccacccgaccggagacggtcggacggcgtgagccgggaaggacgaaaaccgggggacgggtcccgggaactctcctgcaaaccgtacttgggacccatcctccacaccattagaacagccgtattcatacttccctccacttgtcacggcacatccccgaaaggaaccgaaaagcgatgaaacccggtctgagaaaggtcgccgcgctcatactcgcgaccgcgacgctgttcggctcaggcgcgtcggccgtgtccgccgcgtatgcggacgatacgaccatgggcacgtccacgcgaatccaagccgaacccgacaagacgaccacaggcggcgacgaggccgcgacgaaacccgacgccggttccggcgacgaggccggaaccggggcggacgaacaatccggcaccggtgcgcccgcgcaatccgctccgcaggcggatgcgggtcaggccgcgccggacgtgaccgtccacgacatgctcgacacggacagcgccgccgtgagcaggctcaggctcaccgaccgcatcaccggcaccgcgccgttcgacaaggacaatgaacgcggcgacgacaaggacgaaaccaacgacatcgtccgctcctacgatacggtgacctacgactacgagtacacgctcacccccgactcgaccatggactactatcggcgcacgcgcgtcggcttccggttcgaactgccgtatccggccgataaggtcacgttcgacgcggagaagatgggctgggtggaccatacgcccggctacgagccgaaactcaccacggaaaccatcgacgggattgtcacgcaggtgtacacctgctaccgtctgttggagccgaccagccagtcgccgaccgtgaacccgggcaccggttccatcggcctgtcggtcgccgtcaagggcgcgccccacggctaccggttccatccgaccgtcaaggcgtggaccgcatgggacgcctcgaacccgacgaacacgggcacgcacaaacgggccgaggacacgccgaaggatgtgaccgtcagcgcgaaactcaacctgaacgtgcgcatggtcgattacggcaacgtggacaggggcgtgttcgacttctcctcgggtgcggcgaacgcgcccaacaggacggagggcaaggtgaccggcttgggtttgggcgtcgcattggtcacggagatgcgttggcccgaccggacgaaggggttgaagggtttggaggctccgtccggcaggatcacctataggcttcgcttgtccaaccagtattcggatgatacgaaggccgggacgaagcatccgatggaacgccgttggcagccgttgctctacgattacgggcatatcgacaacgaagattcgaagtatgggcggacgttcgcatggatgggcgacctacgatatagggctccgggcgtcgccgaccgtgccgacgggaacgaccgtgtggcgcgtggcgacacgacggtcacgaccacgaccggcgggcagggcacggacgtgaccgtctcgttcgacggctacgacacgtccgtcttccccatccacaataaactgaacggcacacataataaatgcagcacggattacatgacgtcggactgctccaccatgcaggtcggagccatccacacggacgtgttgcagttcgtcacgcccaccagccgtgacggccggaccgtggcgcaatattacgggaacgtggaccagacggccaacatcaccatggacgacatgggattgacggccaccggcgtcagcggagaccgtctcgccacggcggaagacaattcgaatcaggccgccaccggtgacgaccatgcgggttcggccgtgaccgtccgcatgccgggcacgtacagtacgcgcatccgatacacgtgctggaacaacgaaggctcatggaacgatgcgggcacgagctgcgactggacgatgcccgaccgcgtcaacgggtccgacagtctcgtacaggggtcgaaactacgcctccaaataggccacaacatcatcatccagtccgaaggcgacgccgaagtgatgggcatgggcctggtcaaattcgacccgaacagcatcgaaccggtggacgaccatcccgacacgcagccgaccatccccatgaacgtttggacttggggcatgagggcagccaaacggaggaacgcaatcccctactggtacgccgtcaaaaaggacggcaccaactggaaggactacagggagcagcgcgacacgaaaatcagcggactcgactactatccgaccctcaacgaggcgaaaacccatggcacgatagtcggcatgctgttcgaagaccacaacacggtggacccgaccggcacgagcttcaaccgaacattcacgcccatcgtcgccctgcccgcccgcatcctcgacaccgcgagaatcggcacggtcgcacccatcgtcgccgacaccgcctactggacgcgcaagaccctcgcccggaccgcgaacctgaacgtggacgcgccggacacgcaatggcagcaatggtccgacagtctcgccacccgactgcccgaatgcgcgaacggcgtgaaacccgacctgacctacagcggcgacacgtaccggcccgccacgttcgacgaaaacggcgtctatcagggcggcgacaccgccgacttcttgaaaggcgacagcctgtacatagccggcgaaacaccgcacatcgccaaacaggtcgagcaaaccaacgaagccggcaacgttaaaaccgtctacgatttggacaaggaacagcgtgcggtggactggaagctcaccgccaccgccgacacgtccacgaccacggacggcggacaatacacgaccgactacatcatcaccgacacgctgcccaaaggcctgacctacgtggacggttccatgacggtcggcggccaatactcgcagcatacgcccgacaagggcacggtcaccggcggcacgcccgtcacgccgacgatcgtcgtgaacaaggacggcgccaccaccatgaccatcagggtgaacggggcgcgcgccgactccggcacgcagaccgtcatccactattccaccaccatcggggacgcgtccgaccccgaccatgacgtgaggaacaacgattcgttcacgaaccatgcgaccatccagtcgaaacgcaacatggctcccccattggctccaaaggcgcagatagccgacgcgacgatacgagtcagccgcacgcgcgcgtccgcgttggcgacccgcgccgacccgctgctgaacgacatcaaccgcccgttgggattcaggaacatgctgggcaacttctccaaggatgagaaaaccgacccgtatgcggtggacgtcatgccttacaggggcttgaaccagtccaactatcacggcgactacactctggccggactcaccgtcaaggcgggtgcgggtgcgagcatgaacggcgtcaaagtctacttcacgaccgaccagaagtggcgcaacgtggacgcgacgaagataacccgcgaacaggtccaacaatggaccgaagccacggtgaatgcgaccacaggcaaggtgaccatccccgacggctacagcaagccggtggcgtgggcgttcacctcgccaagcctgcctgccaacgcccgctacgatttcatcctgagcatcaagcctacaggcaacaaggcggcggactcgtacgtgaaccggtgggcggacggcgacaacaaggtggacgcggtcacgcaggtcgtggaacgcaaggtcaacggcgtcgcatggttcgacctcgaccatgacggcatccgacaggattctgaccggcttctcgcggacgtgaacgtcaccctcgtggacggcaacggcaggaccgtcaccagtgtggacggcaaaccctgcaccaccacaaccgacaggaacggccactacgaaatcggttccattccggcaggctccgggttcaagctcaggttcacgccgaaaaccggcaccgcctggcacgggcagaacgtcaccgtcaaaaacgcgaaggaagcgtccgaggcgaccgactccgacagcgaccgggagaacgattcgcacggcaacatggtcgccggcgtcatcacgctgaaaccgttccccgcgttggacgagatgacgtccgccgtgtacgaggacccgaacgaggaccacggcatgagcggcacgctcatgctcgccacgcccgccacgttcaaagcggtcaaagtattggacgggcgtccgaacggcgcttggaccgacagggacaggtacgtcgcggacatcaccgcgttggacggcgcgcccgcgaacgcggtgccctccaccatcacgttcgccgacaacaggacgcagacgctccagatcaactccaacgctttcgccaaggagggggtctaccggtatcaggtccgggaacgcaagggagacaatgcgggagtcgcctacgacagccgcacgtgggtcctgaccgtcaccgtcgccgatgattttgacacgttcacccgtcgcatcaccgccaacacgacgtgcgacggcgtgcaatccgacgccatccagttcacgaacacgtacgcgccgaaggacacgcaggcgcgcatcacggcgagcaaactgttcacggacgcggacaggtcggccacgaagattacggacttccaattcgacctgtacgcgaacgacaaggcgaccggcacgcccatccaaaccgtgaacgcgacggcggacggcagggtcgagttcgccccgctcctgttcaccaaggcgagactgaacggcagggacagggccgtgttccgctattccgtgcgcgaacgcaatacgggcgctgcgggagtccaatacgacggacatcatgcggcgtggacggtgacggtcacggacgacaacagtggccagttgaaggcgatcgtcaccaacccgtccgaaaccgaaggacggttcgtcaactcgtattccagccagcccgtcacggtcacgccgaaagcccgcaagacgctcgccaatccgtccggaaccctccgcctgttgaacgccgacgagttcacgttcgaattgcaggatgcgaacgggaagaccctccaatccaaggcgaacaaggccgacggcacggtgacgttcgacaaaatcacctacgacaccgtaggcgaacacgattatcgaatcatcgaacagtcaggcaaactggcgggcatcacctacgaccagaccgtgcatatgatgcacgtgacggtcaccgatgacgggtacggacagttgaaagcctccacctcctacgacaatacgagcaagaccccggtcttccacaacacgtatcagccgaaggacgtgaccgtgagcctcaccgcccacaagacgttcgacaacgccaacaacagccacgcgaagctcaccgacttccaattccaactgttcgacaacgagcgggcggtaggcgtgcccgtgcagaccgtcaacgccgccgaggacggtaccatccgcttccagccgttgacgttcaccgccagccagctgaaaggcaacaagtccaagacgttcacctatacggtgcgtgaaatccgccagtcggcgggcggcgtcaactacgattcccacatgggaatgtggcaaatcaccgtcaccgacgatatgagcggacagttgaaagcccaaaccagaacgaacgcggcctatccgaccacgttcacgaacacgtatcaggcgcagccggtcagcgtgcaattccgcgcgcacaagaccctcaacgaccccgaccatacaggcatccgactgcaagccggacaatacgagttcaaatgcgtcgaggacaagacaggcggtcaggccggcacggtgaaaaccaacgaccagcaaggcaacatcctgttcgacaccatctcctacacgaagacgggagtgtacgactacacgctcagcgaagtccacggcgacaagggcggcgtcacctatgatgctacgaaacatcatgtgaaagtcaccgtcaccgacaatggcgaaggccaactgttggccgacgtgaagtatgataacggaaccaacattccggaattcaccaacacgtaccatgcccaacccgccacggacaatccgaccgcagtgaagaagatgacctcctccaagggcaacaagtacacgctcaagggcgaagacttcgcattcacgctccaccaacagtccgcgcccgccaacgtgtcgaacgccgaccagacgaaacggaacgaccagcagggcaacatccgattcgaccaactgtcgttcccgctcgtcggcacctacgtgttcaccatgtcggaacaggatacgaccgttccgggcgtcaccacggacgggacggttgcgaccatcacctacgtggtcaaggatgttgaccatacgggcaagctgaccgtcgtatccaagaccgtcaccccgaccaccggcgctaacggcaagaacatcacgttcaccaaccattacagtccgaagaacgtcggatactccatcagcggcgtgaaaaacatcgtcaacacggatacggcaaccagccgcgttccacaggacggtgaattcaagttccagttgaacgcggtatccgcacacgacgcggacggcaacgccatcagcgtgaacgacatgccaatgccagccggaagccaaaacggaacagtaaccgtcaccaacaagggaagcggattcacattcggacaaatggtctacaccatgcccggcgtatacacgtaccatgtgaaggaactcgccggaacggacaagaccatcggctactccactcaggaatacgatgtgaccgtcacagtcaccgaccaagacggcatgctcgcggcaaccgccgaccgtcagaccaatgacatccgattcgacaacacgtacacgccaacacccgtcagcgtgcgactcgaagcgaccaaacatctgaccggacgtgacctgaacgacaacgagttcaccgccgaattgaaggattccaacggcaacctgctccaaacaaaacagttcgcccgcgttccacgcgacgcgcaatccgaatccgataaggagaagaacgtccgcgaaggcgacggaaccctcgaattcgacaagctcaccttcgacaagaccggcgtgtacacgtacacggttgacgaacaggacggaaccttgggtggcgtcacctacgacacaaccagccacaccgtcaccatcaccgtcaccgaggacgcggccagccacacgctgaccgcgaagaccgaatactccaccgaaaacggttccgaggacggcatccgcttcgataacacgtaccagccgcagaacgtgctcgtggaactcactgcacgcaagcgtctgaccggacgcgggctgaaggccgacgagttcgagttcgaactcgtggacagggacggcaaggtcatcgacaccgaacggaacgacaaggacggcgacatccggttcaaaccgctcacctacggtcgtgacaacaacggcatcgacgattgcggcgaacaccggtatgtgattcgcgagaagaacaccggtgaaaagaacgtcacctacgacaagacggaacaccatgtgaacgtcaccgtgggcgacgacatgcaaggcaacctgaccgccaaagtcgaatacgacccgacggacgggaagaccgacaagaccaagggggatgccgtcggggacaagccgtccacgatccccagcatggtcacgaccaccggaacccgacccgagttcaccaactcctacattccaccggtcacaccggccatcgtgaagacgattcgccaactcgccaagaccggcgtatccgcgcccatcgtggtgttggccgcgtttacgctcttgggagtgggattgatgctgttccgccgtcgcggaaaccaaaccgagaccgcgcggcacaggaagtaaggccacggtaggccagtagaaaggccgggcgggagagctgattccccgcccggccttttcttttgcaccggctgcaaggtgacgtcctccctctcggccgaagctgaaccgcaccccgattgttggactgaagaaattcagattcgatgatcggaggtgcggttctttcgtatacgtgaggatcgaaggagacgttacgacgacgggttccgggcatgggaaaggcccttcgccagcctctcccggcggagggcctttcccatgcccgtgaacccgtgaacccgtggagccgcagacccgtggaaccgtgctcccgatggggcctgtagacggtgcgccccgcagcggcccgcgacccggcgcatcatcgactctgacattgttcgcaccatcatcattcttctggaggttgcacatggctgacaggcaaaccgcattggccgtattcgattttctcgactcgctgcgcgccggacaataccgcatcggcgcggacgcggaaaaggaccatgccacggcgggactgctggcgtcgctgtccggcgacacggggctgcgcgacgccgtgtgcgccaagctgatatcgccgggcatggaacgcgcccgtttcctcatggtcgccgagcatgatccgcgcgccttgcccctgttcgcctcgggccaggtcaaaccgtggtaccaggccgactacaacgtgcgcgagatcgccaacagcgagttccaccaggacatacccgcactgctgtggcggctgtccaacagcatcccggattccgcgcgaagggagggcatgcttgaggcggccgcgtacatgagcttcatgcagggcgatcccgaggccgcgttcaccggccatctgggccggctcgcggcggtttcacccgagggcgaggtcacgcgctgcctcatggacgcgcacgaacacggccagcatcccgcatgggtcatggaacagcggcagctgcgcgaacggcaggccgacgccgccgacggcatgaccgccaccgcgccggaccgcccgagccttcgccagcgcctcttcccgaaccgatgaacacctccagcacggacccatgggagatgggccccataatcgccgccggcaccgccgtcgccatcggcacggcacgagaaccggaaccggaacgccggccaccggccgaacccgaacccgagcccgggcccgggctggagccggatgcgcgatgcgtggacgacgccggaagcgaagaccgggcgaacacggccgtcgatccgtgggagatcggcccgctgccatcggcctcgaatccggtggggaatgatatcccggccgatgccccggcatcggaaccgcagcacgttgtcggtgccgtggagccggccgatctcgccgacacgatcgacctcacgccggtcggcgaccgggatgccgccatgcccgtgcgcgaatggaggcgcatagccacgaccgcgggcggcatcctgctcgcggcctgcgtcacggtcgccggcatgtccgcgtggagatcgcatgaatccgccacggccgcacgcgagctggaacaggcgacggcggactgcgccaccgcccacgctgcggcgaagaaagccgaacagaagctggtcgaatatctcgacggcgaccggctcgcacaggcgaaagcggtcacggccgacaagctcgccgacccggaaaccctggaaaccctcgacaagctggccgaacaatattccgagggcgagcgaatccccgcatgtgccgccacggacacggaaacggccatcgccaccacatccaagctgcaagccatcgaaaagaagcacacgggaaatctctcgcggctgaagaaggcggcgggcgcggtgttctcctcacggctggcccatacggtcgaacagggcgaacgattgtattcctcctccgaaggcaaggtggccgacgaatattcgcgcgccctgctgcgcgcctccatcgacaagcgcgacgagaaggccatcgccgacgccatggacaaggtgaacgcctccatcgacgcgaagaccaaggccgacgaggaaaggaaagcgcaggaggaggccgcagcggctgcggcggcgcaggcgcagagcacgccggcaccgcaacagtactcgtacacgccctccggctccgcttcgggcccgggttccggcccgtccggcggcggataccattcctccggcggttccgccggctcgaccggtggttccgcgtctccgggctggtcggtgcccgcgaacccggacccctcgcaactgcccggcaccgacccgagcctatgaaaggaccagcaccatgccacaactgaccacgttgatcccgtcgttcgcggcacccgtcaccgaccgcgtgtggctggtgggcgcgcacggcggtgccggatgcaccacgatccgccattcggaccccgaccggttcgccgacgccggccgcgcgctgccggtgagccaggatccctccatgccctcgcgcatcatcctgtgcgccatgggcacggggcgcggcctcgaatcgttgcgcgcgctgctcgccgaccagtcggccggactgttcggcgcatcgatcctgttgggcgcggccatcaccgaccccgtgccccgtatgccccggcctttggtggcggcgcgcatccaactgtcatccgccgtccgcgtgtggcggctgccccatatcaaagggcttgaactcgacgggtttccccggcgttatccggccgcgtactcacggctcgtgaaggacgtagacgccatgccccgcgccacggcccatgtcggctgacgatggtgcatgaacctaacacgaaaggaacaacccaatgctgcatgaaacatacgcgatcctcgccgagaccctttccgacccgaccccgtgcctgcctccgggattctcgggcccggtatccaccgccctgggctgggtgaaggcgctgagcctggtgatcggcgtggtcgcgctggtgcgcatcggcgtgcacatcctgcgccagcagggcgacggcgtgccagaccgcgacgacaccttcgacaagctcgtcaactgggtgatcggcatcttcctcggtgcgggcgctgtcgccatcctcgccgcactcggcctgtccgtcaccgcaagctgctgagaaaaagccatgaaagggattcgacgcatacggcagcgcctgtgcgcgctgctgctcgccctcgcctgccttgccggcctcgccgcctgcggcggacccgacttcggatcgttcagcaaggagctcacgttcggcgacaagcagatcagcgacacccagaccacctacgtgatgaagatacccgaaggcaagctcggcgacctgatcggccccagccagatccaatgggtcatcgacaagtaccgggccggctgggtgcgtgccggaatggtgtccgcgaatccgaccgacaaggagctcaagaagtatgcgcgcgtccagttccgggccgcgccgaacctgcaatgcgatgcgttggagaacacgtaccaggaggagtcgcccgacgagggcaaatgggagtacaaggactcctcgtgccagaagcagcgcaagctctcctggctggagaagaccctgtggaacatgtaccaggtccaatcggattccacgatcgaatggctgtccaccagccgcaacacgctggtcgccgcgaacgacacggtatcaacgttgcaggcgaacgccacgccggactacgattcatggttcgcaccggtgaaccggtacctgcgcatcgcgcagggcgtgctcgtcgcagccgccgcgatcagcctgatcgtgctgagcgcgcgcatcgtgtggaacatcggccagggcggcgagggccgtctgctcgaccgcatcggctggatactgctcggcgtgctgctcggctcctcgtgcgcgagcatcgcgctcacgttcttctcccgctcgtccggcggcaatccggacctgccgtcatggacgccgggcggcggcaccacgttcttcctgtcggactacatccgtatgcaggttgacccgttccttatcatcgcggccgtgtgcggcgtgatcgccgccggctggaagctcgtcacccaacaggagggccgcgaccttatcccattgggcaaggccttcatgtgggcgatcctgagcgccgtgtgcctcgccggactggtcaacacgttccaggccacattcgacacgtggaccgccgacgtgctcagatccgcctccggcatgatgaacgacgcctgggaatcgaaaagcctggccgcgagctcgttcttcaacttgggcgcgcccgtcgccatcgtgctcaccatcgtgatgtggatctgcgggctgatcagcaagatattcgcctacttccgcgccgggatgctgccgatcctcgtgggcgtggcacccatgtgggccgccatgagctggatggaatcgggcaagcaggctttcgccaagaccatcggctggctggccgcgttcctggcctacaagcccgtcgccgcactggtcatggcgaccggctcggcgatcatggccacggccggccccggcgacgacagccaggccatcacgctgatgctcaccctgagcgtcatcatcctccttcccgccatgatccgcgtgatcgtgcccgccgtgcaatcctcggtcggcggtggcggcggcggaatcctgccctccatactcggcatgggagtcgccgtggccggcggcggcctgcgcaaggccatgggcggcaagggcggcaggaaaggcggcggcgacggacgcggcgaagcgtcaccggacggtgccaaacccggtgccggtcgcggcctggccggactgctttccggactcggccgaaacggcggaaagccgcagggagcgaacggcggcggcaagcaagccaagccgctggacggcaatcccacgggcgacgaaccacagaacaccggcgaccagccgcagggagcgaaccgcaagggcagcgacggcaagccgcagggagcgaacggcaatggtgcggggagcccggttccgccggcacccgatggcgcatcacccgacccgtcaggcggcaacaggccgcagggggcgaacggcgatgccggcgggttcgcccgcgagggcgcaccggacggtgccgatcgctcggccactcgcaagggcaagacattctgacgcatacgttttgttaaggagattcggatagccatggcgtcgaacacgacatacggcgattggatgcggccgatgccgggaggcatccgcaacatcggcatcccgctgacgatagcgggcatgggagtgctgacctgcacgctgctggtcagcatggcgagcgtggtcgcggccatcgcgatcctcgtggtcggcatgggcgtcatcctcgtgctggcgatcagggaccgcgagcaccgcaacatggtggatcgcgccgtggagaaacgcacgtggatggccgcgcagcgtaccggcgcaaacctgtaccgttccggcctgctcgcgccgatcgacggcggcaaggccatgctgccgggcatcctctcacgggtgggcctgacctccgccctggacgggctgggcggcgagttctgcttggtgcggcattcgcacaccggcgaatactcgctgctcctgtcatgccagccgcagggcgcgaacctcgccgacgacgacgtggaggactcgtacgtggcctcgtgggccgggctcatggaatcgctcgcctccgagaccggcgtcacccaactggccgtgaccgtggacacggcacccgattccggcgtgcgtttccgccgcacgctgagcagacgcatcgtggaggacgctcccgagctcgcggcgcgcgccatggcgcagatcatggaccagtacgcagccggcggcgcttccaacgacgtgacgctcaccttgactttccgctacaccgaccgtgacggcaaatacctggaggccggggaggccgcgcgtcgcataagcctgctgctgccctcgatccgcgagcagatagcgcaggcgggaggcggtgccgcgagggccctgggcatggaggagatcactcgcatggtccgcgtcgcctacgatccggccgcgcaggagaccatcgaggaatccgacgagcccccgtacatcgcatgggaggattgcgggccgctcatgcacgaggccggctggagccattattcgcacgattccgggctgagccgcacatgggagatggtggacccgccgcaaagcaacgtgaccgccgacacgctcacccgactgctcagcccattggcggactgcgaccgcaagcgcgtcaccgtgctctaccggatgctgccgcccgacaagaccatgttcatggccgaacagaaccggcagaaggcagccaaccaggtcagccaggagaaacgcgccacggtgaggtccatgagccagataggcaaggccaaccgccaggccgtcgaaacgaaccagggtgcggtcatggtgttcttcgggatgctcgtcaccgtcaccgtgtccaggggcgaacaggaaagccaacgactcgaagccgcgtcacgcgccgtggaacaggccgcaggcggcgcgaagatcgacctgcgcccctgctacggggcacaggacacgggattcgccgcaagcctgccccttggattgaacgtcagatcatacactccagccggccccctcggccggctcctgtcctgaacggaggacacatgatgccgatgccatggaagccgtcgaaacggaagggaaccatgccaagcgccacggccacggaccccgtggcacgcatggaatccatgctgctcggtccgttgaaggccaaaccggacgagcccgtgcccccgatgccgtggcgggggaaacgctcgcgtggaggcggctatgcggccctgatgcccacgatagacgagttcttcggcacgtcgaaccaggtgtgcggcgggttctggccgttcggcaccgacatggccctgccggccgagggggtgccggtcgggcgaagcctgatgacgggtgccggcgtgtgctgcgacccgatcagctggttcaaggccggcatcatcaaacagccctctatgttcctgctcggcctgccggccatcggcaagagcacgttcgtgcgccgcgaggtgctgggactgagcgccctgggcatgaacgcgatcatccccggcgatctgaagcccgactacgcctcactggtcaacatgctcggcggccaggtcatccggctgggagcgggcatcggcgtggtcaatcccctggaccccggcgacctccattatgcgctgcaacgcttggagggcaaggcgcgcaaggacctgacggactactacaacgacacgagggcggcgctcatggaggtgcttttgacgatcatgcgcaccggccgcgaggccgacgacgtgggcggtgccaggggcgtgaccgcacgcgaatccgatatcctttccgtggccgtgcgcgtgctccacgaccggcacggcgacgacccgcagcctcccgtcatcgcggacctgcgagacctgctgcgcgaagggcccgacgaggtgcgtatggcggcggtctgggacgacccggaaaacgacgagctctacagggcgcaggttcgcggccttctggccgacctgcacggattctcgaaccgcatgacgaagttcggccgtctgttcggcgaccagaccaccgcgcgcatcgacctgtccaggcccgtggacttcgacatcagcgccctggcccagtcgggcgacgatgtggtcgccgccgtgctggcgaccacatggacgagcgcgttcgccgcgaagaacgccgccgacatgctcgccgaggagggattgcagccccggcgcaaccacgtgatcatcatggacgagatgcaccgcgctttgcgcgccagccccctcatggtcgaaaagctcgacctgctcacccgtctgaacaggcagtggggcgtaggccagatcatgatcacacacacgttcaaggacctgatgtgcatggagaccccggcgcagaacaccaaggcgcgcggcttcgtggaacgcagcgagatcaaggtgctgggcgctttgagccgcatcgaggtggaccgctacctgcgcggcgaatgcggactgcccgtatcccggcgcgaggaggacatgctggaggattgggccacgcccgtcaacttcggctccgacgcctcgcacaagggtctgggccgtttcctgatcaaactgggaggactgcccggaatccccatcaacgtggagatgtgcccgctcgaaaaaagcgggttcaacgatacgaacctcaaatggcacgcctagaagggaaccctgcgatgacagaccacctcgccaccggcatgaaacgcatgatccgcaccgtggcacgctccgcatccctctccgaccggctcggcgagcaatcccggctgctgcggctgacgggcaaccgcagcactctcgacttccgccccgccgagcacggcgcatcctcatgggacttcgaaatgtcgataacccccaccgagcccaagccgtacggcaatgcggaaacccgtgaacccgtatggcgtgagacggtcgattccgccacctatggcgaatcgagggcgcgggtcgcgcacgccgtcgaaacgttcagaatatacgacaacaccggcatcctgccggaaacggaaaaccggtgaaaggaccacgatgaacgacgccgcactgctcgactcgctgcacgccgcgctgcgcaatcccgacctcgcatggtacacggaattccatgccggcgaatccatcgtcgccggctacctcgattccctgacggacccgtatgacggcgatgccatacaggttcccgagggctggttccgctactcggtcgtcacccgtgaaggcgaccacgcccttccatggatggagcactggaacgaatacgagtattcgatcacccatcacaccgattggaacggcaaagggttcacgccatacgacctgtactgcacacaggacctcaccggcatgatcgccgacggctcgctggcctcgatccgggaggacgcgcgaaccatattcaaggaccggtccctgacggacgactaccttttcgccaactccatctggcccgaaccggaactcctcggccttgtggacgacctgaccggccgcacgggacgaaacctgtaaggaccctgtagacgccatgccccaccccgccatggccttggactgatgatcggggtcatggcgggaacgccgggttgccgccgaggattgtcaaggagccgaacatgcctttggagaacaccggtgccgaagagcggatcacacgggagacgatgatcggatggatcgagcattggggcgaatcgtatgacgacgtgcgacccgatgacggtgccgtgcggctggcgaaccgcatcatcgaatacaacgcggcgactgaaaccatcgaggcgttgcggaaccccgatgccgtgtacgacgaactggcatccattctccagccggtgctctcctcgatggacggcacctatttcgcgggctccgaatggttcgccggcgaagtggaccgcatggaagcggaccgcatcaacggggagcagccggaagaaacggacggcctggcctccgaagagccccgcatcccgttcatcgtggagagcgaggccgcagccgccgatacggacgaaccgccgttggacgagctgatcaccgcagccacgcacgaatatctggactcaggcatgacctacgacggattctcggaacatgtgcgcaccatctggcgcaacgcggcagcctacgactggtcgaagctcatggccgaacagcgctccacgggcgaatggtcgtccgacgcgaaccggctcgccgtattgggcgtgatgatgcagttcgcgcccgaatcaacgtgcatgatgatcgccagcgacatactggccgagaacgctcccctatcccttccggcattgcgcgaacgcatcaatacgccggacggcatggtgaacaccgacctgctgttttcccggctgatcgacaacggcaccacgcccgatccggcgcgcatcgacatggcgatggggatcctcggcccgttggaggccaacgcgccgacggacgcctgctaccggatcatcggcctgaaggccatgctcagcctcgccatgggcgacggtgagaaggcgcgggaactcgccgaacaggccatcggctacgacgcctcggaccggttcgcgtcaagcgtgctcgaccgtctgccggaaaccgatcccgccatggaggcggcgaacgtgtgggagaacggcgggcatttggggcgctgacgtagacgccgtgccccgcgatgccaccggtccggccggatgatgggagtcgccgccgccattgaaggcgctggtattttccgaatgaaaggaccatcatcatgccacagtcaatgcaagtggttcgcggtctcctcgccgcgaaccccgattactggccggcgaaaaccaacgcggacggcaccacgagctcggcgtacctgcgcgccaccgtgtatgaggaccgcccgcgagtccgtcagaaggacggcagctatacggacaatccgctcggcccggtgagaaccaccgtgaaattctggggccaggctgccgagctcctgcacggcatggatttccgccagggcgacgccgtggtggcgaccggccgcatgggcgatcccgacgccttcatcagccagaaggacggcaaggcatacgcgcgtccggtcgtgatcggcgattccatgcagatcgattccatcgtgtcccagcgcatccagctcgcccgcgaacgcaaacgccaggacaaggaacaggccggtgccgtggccgatgccgggcgaacggatccatggacggaccaggttgacgcctcgcgcggcgaatacgttggcgacggcgttccccgcactttcaacggcgagcccttcgaaccgctgtcgggctatccgacgccgggcgcggcccccgctccggcggaccctgcggcaccggatttcctttccaccccatccgatttcacgacgggcaacgcccgctagccatgacgcaagccctggcgcatcgacggcgggaccgcttccatcggttccgccgtcatgcttgaaaggagaaatgaatcttggccgacgtcgatccgaaactgcaatcgaaccgagtgaaggatctgggcggcacggtccgtcccagccgcaagatcgaactggcgatcatcgtcgcggtgtccctgatcctcacggtgttcgccctcgtgtgctcccatgcggggcatcccttccagatcttcgcgctcatgtacctggtctccggccaatggtcgctgaccgcaggccagtgggcgctggccgtggccgtgctcgtcgtactggccgtggtgtgcggcgtgggcgcgtggctgatcgccagcaaggccgtgccgtgggcaaccggtgccaaggcacgcacccgcgtggacgtgtacgcgccggcgatgggccatggcgaggccgtggagaaggtgacgcgccagcgcgccgaggccatggcgtcaaggctcatagaagcggaccactggcgaaagggcatgtcgccgggctatccgctggggctcaacatcgtggacaacacgtcgatgtacaccagttgggaggacatggcgatcgttctggcgggcccgcgttccggcaagtccctgtgctacgcgatcccggccgtgctctcggcaccgggcccgtgcctggcgacctcgaacaagggcgacatcctcgacgtgaccgccccgatccgcaggctcgaccatccgaacggcgaaatatggacgttcgaccccgaacgcatcgcggacccgaaccggaagagcgcgccgtgggtgtgggacctgatcgcctcggtgcagtccatcgccgacgcgaaacgcatcgccgactgctggcgttacgcctcgggccagccgcagaccggcggcgacgacttcttccccggcaccgccgcccagcagctcgccgactacctgttcgccgcgcatctgggaggccgttccgtgtccgacgtgttcaggtggtgctccaacgagcgcgacacgtcgccggccgacatcctgagcgaatacccgcgctacgcgggcatcgcctcgcgtgtgtccagcgtgatcgcgctgacgccggaaacccgaagcggcgtgttcggcagccttcagaccatggtcgcgttcctcgcggaccccgagatcatcgactggatcgacccgcaccgggatacgaatgggaacatcgacgagcggcgtggtctgttcgatccctacgagttcgccacgagcgaggacaccctgtacctgctttccgcacagggccggccctcgaccgcgttgaccgcgagcctgacggcggtggtggcgttcaccgcgttccaacgcgcccaatccgagttcaccggcaacaaccgccgtctgccggtcccgttgtgctgcgtgctggacgaggccgcgaacatctgccgctggcccgaactggcggacgtgtactcgtatttcggttcggcgggcatcccgatcatgacgatctggcagaaccccgaccagggcagggccgcgttcggcgagacgaacttcggctcgctgttcaacaacgcgaacatcaccgtctaccttggcggcatcaaggacgcgaagttcctcggcgagatcagccagctggtgggccagagggagatcgtgcgaggcagcgtcaacatcgacggcaccggccggcgcagcgtgaacaactcgatccagaaggagaacatcctcgacgtttccgacctgaccgaatggcccgtcggccgcgcgctgctgctcgcatcccaatcccgggcgcagatcgtcaagaccctgccatggacgggcaacaggcaatgggccgacgccctggcgcaggccaaggcgaaagcccgagaagagcagagaaaggccgcataatgagcgaacacacctcgaacaccacgtccggccctgatggggaggaatgggagcgcgcggtcggtgccgccaggaccctgctgtcatcggactgcggatggctggaactgttcacccgcgccatcctggaggagaagggcgtgccttacggcaagggactgcccaaccccgaagcgccgcacatccccgaggacaaggagatcgaagaggaaaccatgccgggccaaggcgagccgacgccgaccgcacccgaggtgccggcaggccggcacgcggcggaacccatccgatccgggattccggccgatgccggggaaaccggcaacggctacgagaacccgccggaagacgcaacggaccgtgacgacacccctccaaaggccggtgcggaggaatccgacacccgtatactgcccgcgccggaggggaagacggatctcggccgagacgaatccggcgacctcgatcccgcgcgggcaagggacgtgtccggccagttcggcgcgcgaatgcggcgcagcgagacctactatccgaacctcgccgcgttcgtggaaaggttcgtggccaacgtgttctgctaccaccagagcgcgagcgtgaacatgcaatgggtgagcgactggtggcgctatccggcgctcgtgttcccgctcgacgccatgtggcgcgcctacgagaacgcgcgcaaggcacccggccagatgatgatcttctacatccaggcggcgtcgatgctcgaccgcgttttcgacaaggaccgtggcatcgtcgccagcctcgactgcaagcagaatctcaccaggaagggcgaaccgctgccctgcgaacgcccgaaccgggcatggcgcgaaccgatcctggaaacgttgtcggtccccgccgcaggcggcaaggaaaacaaggaaaccaccatcacgccaacaaggaggagaaacaatggctcaaactgatcccgaggacggcttcgaccagatcatggtccagagctggaacagcgtcgcccagcagctgcgcaccctgcacaacgagctgagcggcgaccgcgcgcgacgcagggaacgcgccgaacgcgccgtccagaacgaacgctacgagcagaccagacggcagcagcaatccatccgcctcgaacaatgggagatggacaacagggaacgcctcaacaaggggttcgagtccaccctgaacgcgaccgtgcttgccgacggcgacggctggaggaagatgcgcgactcgtccctcttgcaaggatggatggtcgccgaccaactggagggcaacgaccccggctaccgcaggcagatcatcgaggcgaaggcccggctgaaggacgaatggtcgaaacgccacccggaaacgcacatcgacgccgcagccgaccaattgaccaaccacgtgaacatcacctacaccgaccagtcgcccgcgttgcaggccaccctgaacgccttcaacacggccggcgtgcccgtggacctgcaacgggtggaggacgcgcaggcgttccaggccgcgcacggcgacgacgccacgttcttcgtggactcgcggctcaccggccaatggacgggctacgaccacgacaggatcgttgacgccgtgatgtgcgcgccggtcaacggcgtggacgacgccgcctcccgaatcagcttcctcaaggaccagggcctgccggaatcctcgcacgcggacaacaaggccacaggagacgagcccagcaccataagcgaggtcgaacgcaccgagaacgctgacgccgcgccaatcgtcgaaacccccacacccgtgcgggagcatacgaagcccgccgccgatgaacgcaaaccggcatccggacccgagcccgagaccacgggaggcggcgacctgacgaccggggagcccgacggatacgaggagatgccactcgacctgaacgaacccgaggaatggaacgggcccgacccgttcggcgaatacagtcccgccatggaatcctccatgaaccccacggaccagccgatacccgaccaggccaacgtctcgacgccgcagatcctgcaacccgagaccaacggcaacgcacgctgacgccgatgccggcgccccccttgccatgaggttcgtggggtgcgccggcatcggatggccgtatcatggtgtcaacggctttcggaaccggaaaggacgagcatggcacacgtgacgttggatctgtcgaaatatgatgccctgaccgcctacaagggtcttcccgacgagaaggaggagaacccggcgcggttcttccccgacacctcgtcggtccgccgttgcgtgcgcgaacgcatgtccgtcatgggtctcgacgccgccgaactcgccaggagagccggggttcccctctcaagcgccgaagagctcgtggagaccggtctgacctccatccgctacgtgtacaggatgttcgacctgctgcacatccgcaccgaaacgctgccgtccgcctacgcggggagactgctgtgagggaactgcacgcctgggagaacgggcatcatgtgggcgtgttctcggaagacgacgaggagcgcatatcgttcgcgtatgatgcgaacgagggtctgccgatcagtctgagcctgcccagaaccggcggatggagagaccaggcaccgcgtaatttcctggacaatctattgcccgacaatccgaacgtccgccaggccatgcgtgagcacctgaatgcctcctcggccggcgtcttcgatctgctggaccgggttgacgccaccggcggactggtgttctccctctccccggaacctccaatcccatcgccgacgcttcgtctgatctccgattcccagatagccaacgaaatcgaccgcatcgagcggaccaggaactactggtgggacgaggacagccactgccggttctccttgggaggggcgcagggcaagttcacactgtcccgcgtggacggcaagtggtattggccggatatgatgctgccctccacccacatcgtcaaaccgaagccccatgaccttcccgaggcgaccaaggtggaactggcgacgatgcgattgtcggaactgtgcggcatcgacacacccgcgcgcggcgagatcacggcgcagcgcaagacggcctatatcgtggaacggttcgaccgtcgcctggaggaaggccgaatcgtccgactgcggcaagaggacttcctgcaagcgttgggattgccgacccgcgacaaatacgatccgtcggccgatgactgcctggatctcctgcaacgcatcgatgcgtcgggttccctgtcctaccggtggctcgaaaggctggccttcaacacgtcgtccgccaacagcgacgcgcacgcgaagaactattccctgatcctcgatcccgcatcggggatacgcctgtctccccagtatgatgcggtcgccaccaggtattggcccgagttcaattgggaactcaccatgccgttgaacgaggatcacgccttcgcggagcacaccacgccccaggattgggaggatctggcgacacgtcacggtctcgatggttcgagggtggcggatatggcccggcgtatggcggggaaggtcctcgccggcatatccgaatcctgcgagggcctggacgcgcggatggccgatcgcctgaacgcgtgctggacgaaggcgaacgagtccatcgagccgatcatgccgggagacgagccggcgaactctctcgatccagcatcggctttgcccgattcgctcggttttccctcctcgggccgtaccatctgagttttttccgggaagcgtcctaacggcggggccggttctcctcgtcagaggcgaccatgctccatagaccgtattccggcgcgattccgtagcgttcgcgcagcatgtcgaacgtgtgcaggccctcgcgcatcgctgcccggtattcgtcgccgtccgccgcgttgttgaggctggcggcgatgcagaacgcttcggatacgaggcgttccatgtcgtgcgtggacagattctcggggtgtctttctcgtccgtcatcgaggaagggcgggcggttctccatcgcggcgcgccattcctggacggcgaggctgcggcttctggcatcgtccgcccagtcgtcgcgcagtcgtttcaatcgcatgtcgtcgccgagctcgaaggcgttgaaccgttccgtccacccgtccgtgctgcgccacgtgatcctgtagccgaccacctggccggggtcggtgaacgagtctttggcggttcccttgcgcagcctggggtcgatggagaagccttccctgcgtatgcggcgtatgaactcgtcctcgctgcgcgatgccttggcgcacgcctccacgattcgggcgatgtattggcgtggcatcgttgaggcggcgaccgccgtgacgagccggcttctctcgttgccgtccaacgcatcccatccctcgtcgtcgccgtactcgtttcgcgccttccattcggcccattgacgccattgcccgtactgccagctgacgcgcgtgccggtgtcggagcgtgcgagctcgaccagttcggggcgcgatttctccatccgcctgcatgatttctgcgcgttgatccggtcgtggtacgggttgatccacccgtcgtcggcggcgagctgcaccatgatgtgcacgtggtcgttgccgttggcggacagtccgtggcggaccgcgagccatgtgacgccctgatcgtcgtcgccgtcgatgatgttcatgcgcgtcagataatcgcggatgacggcctcccattcctggtcggtcaggattccctgcccggccttgatggcgagcgagcagtgccacacgcgcttcctgccatgctctcgttcggggttgttcttgcctcgcatgtcgggcgggaacggatcgtccttgcgttccctgacgcggtagcgtcggtcgaacctgcggcctatctccgcatacgacgccgccggcttgccatccatgtcaaacgagggaaacatgtcgccgctcgcgcacacgagatgctggtcggtgtgttcattgcgccgtcccttgccgaacaggtagcgcaccaggccggccgggtccgagcccctgacgatattcggtatcatacgatgattctccgcccgcgcgcccggcacggcggcgcatggcgtctatgagagatatgcgtcctttgccggcacggccacttcgatagaattatcggaaacggataaggggctttgatggaaccggtgaggaacgatacgacgacggataggcgcacggccgtggaactggcgaagcggctgctggtcgatttgatctggcgcaccgccaagatcgaggttgatggcgtcaccttccccgacacgcaggagatcttcgacgggcgcgcgcccgagggtatgagcgtggacgatatagtcacggtgaataacatcaagcgcgcgtggaggttcctgctcgggaacatcgactatccagtcgattggcagtacatccgcgaatacaaccgcatcatcggcgaaggccgcgtgcgcgacgccggccgcttgcgtgaatacggcgtgaggatcggcggcacgggatgggtgccggagatccccgccgtcgagtcctcacaggaaagggttcgcggcatcctggaggagtcagaaggggaggccactgcgatgctgctgttcggcgcggtcacgcggggacaatggttttcggacggcaacaagcgcaccgcgctgatggttgccaaccaccagctcatacacgacggcatcggcgtcttctcgatccctcccgaagacaaggcgcagttcgtctctatgctcctgcgctactacgagacgggcgactactcccggctctccgattggctctcacagaacgccgtcggccatgtgcccggcgggctgactttggcccaatcgtctggggtcgtggaaaagacgaatgatgccgtgaacgggatgggcaccgtgcccggcgttcccctcgacggcctcgatggaggttccggcttactgaggtgacggtcgtggcgtccgggggaagtttgctcccgaacgccacgggattatttacgcgatgatttcgcggggtgtcgggccgcgcccttctcatgtgctatcctgggtttctcgggaatcggaggaaccgtatgagtgagatcaggatagcggatttgttcgccggcatcggcggcatccgcatgggaatggtgcaggcgctgggcgatgccgcgcacgtggtgtattcgtccgagtggaacaagtacagcgtgcagacctatgaggcgaactggcacgacgagaatcccgtggccggcgacatcaccaaggtcgacgagcatgacgttcccgacatcgacctgctgctcgcgggattcccgtgccagccgttctccatcgccggcgtctccaagaaacagagcatgggccgtcccaccggcttcgaggacaagacccaaggcacactgttcttcgacgtggcgagaatcatcaaggcaaagcagccgaaggcgttcctcctggagaacgtgaagaacctgctctcgcacgaccgtgggcgcacgttcaagacgatatattccgtgctgaccgaagaccttggataccacgtcacctacaagctgatcgacgcggcgggcttcgtcccccagcacagggaacgcacgtacatcgtgggcttccgcgaggagaacgggttcacgttcgatgatgtgaagcccatcgcgcacggcaacgtcggcagcatcctcctgcccgcctcccaggttcccgacaagtatgttctgagcgacaagctgtggacgtacctccagaactacaagaagaagcacgaggccgcaggcaacggtttcggatatggcatggtcgatgccgccaccgaccacacgcgcacgttgagcgcgcggtacggaaaggacggcagcgagatactggtctcacgcggcgagggaaagaaccctcgaaggctaaccccgcgcgaatgcgcgcgactgatgggctacccggattcgttcagtatcccggtatccgacacgcaggcataccggcagttcggcaactcggtcgcagtgccggtcatccgagccataggcgaggcgatgaaaccctacctgtccgactgattcgcccgaggcgttccctgtccgattggtctatgctcatggattatgagcgattacggaagaatcggcgactacatcggcccggtcgcggccaagaaactgtcggccgtcgatatcgacgccaacagcagcaaccagcacgagttcggcggcaacgacgcgctcagaagactgctcggcaccggcgaggatcgtagagcctcacaagggcacggcatacccaccgcgctcatgtacctgagcgacgatgacgcaccggcggtcgccgacctcgaaaccacatggtacgacgcgcggcgcaacaacccgaatcgcagcgccgaatggcgtctctactacaaggactgcgagccaatccgcatggcccgccccggcgacctcatgtgcttcggtatgctcagggacaatcgtctgctgatcatcatcgcacagcatgacagcacggccgaagcccaagccaaatggctcttcggcatcgacgacgaacaggagggcgcgttccgcttccacgacaatacggaacgtgagctggacgccttcggcgcgcagatcttcgaagctctcggcatcaacgtcgaagtgcgggatgacacgtatctccccgagatgatcggcagatggggatacaggttccccagcaacgaggagttcgcggccttctcccaatcctccttgacggacgtggaccccacgcacgatgaccctgacgacgtggtgatcgaatactacgaccgcagctacctgctgttcaaactctatgagcgggcggtcatccaacacgactacgatgccgcgccattcgtatcggatggcgtcatcgacgttgactcgttcacttcgttctacacctccgtgcgcaaccggcgcatgagccgcgcaggcaaggtcctcgaaatccacatcgcccacatcctcgacgcgcgcggcatcgaatacgaggcgcaggccaagacggaaaacggaaagaaacccgatttcctgtttccctcgcaagccgcctacgaggatccggcgttccccgaggaacagctgcgtatgctcgcctcgaaaacctccatcaaggatcgtttccgccaggtcgccgacgaagccaaccggatcagggacaaacacctgttcaccctgactcccggcgacgtgacccatcccaagctcgcccaactcgatgaactgcacatccacctggtcatgcccaaggtagtcaaggaatcctatgacgacctgatccagggagaaaccatgacgttctcccggttcatcgaagaaatccaaggactacaagcggaccgtccgcaaagcctgaccctcctctgaccggttcgcgtcatcaggcactcccccggactgcccgatgacggcatcgagatggtctatcagctcccggcattgccggacggcgtaggacgccgatgcctcgtcctcgatggtcgcgttcatctccctgttcgcgttgtgcgcgatctggttgacgttgcggccgatgcggcgcagctggtattcgatctccctgagcgcctggacggtgggcgaatcatgttcctcctcctcgacgtacaggcttccctccaacagctttaccgcttcgatgatggtgagggataccgtctggttccgtttcctcgcggcggcgcggatcatcgcggcttcctcttcgttcaccataagatgcacttggatggagcgctgcgcgccgccgcctttgctgcttcttttacgcattattctttctcctcctccatcggccttcggcactcgggttgttgcttcagcgccgtagggcgcgggaggctgcgggctcggttcatgtacatgaaccgtctagcttgcttaccttcgatttgatgggcatctccatgtggatgtccatggacatatccatgtggatgtccatagacgtgtccatgtgggtgtccatggatatatccatacgagcgcataggaaaacgcatgagggtggatgatcgttcggggtgatgccttcttccacgaatgggaaggggctcttcctttttttggaatgtcatcttcccgcatccttcgtcttgagctccttgagcagcatcgtcgcgttgtcgcggatgctcgcgtccgtgagcggggagagctcgtccgcataggagcggcagaggagcgcgtacacccgttcccgcacccaggcgctgcgcgcgatgcccagcttgaacgcggcccggcacagcatctcgtattcgtcgccggtgagcatgacattgagctggcgtccccgcttcagcggatgttcggggtcggggtcggtgcggtacacgtcgttccaatcggtggtgccgggggcgagttccgtgtagctgaacggctggatggcgtatctcacgaaacgggatttgggtatgcccgtcttggtggaggcctcggcaagcagattgaacagctcccggtccatgaggacccggaaggcgtggctgtatcgtcgcatggtttcatcgtctccttggtcgttgccgtgcccggcgcggcatggcgcgtcgggcacggacggttggccggttggtcagcggtcgaagtcgaacgccgtgccgcgtaacttgtcgatgcggatggccgcgtcgaacttcttcccggatttggatgtgaagcccttcagggtgacggattgtcccgcgaggagcctgcgcgcggtctggtcggtgatggtcttgcccgcgatgcgcgcgaacatcttccatccgcagcctgcggtcgtggcccacttgccgtccttggtcttctcggtcttgttcgtggaacactgccacatccggccggttttcctcaccggctggccgcagcgcgggcagtcgccccaatcctgcgcgtcggtgttcgcggttcgtgtgacggcatcggccttgaggttcgcggtcgcgtcggcggggattcgcaatgcctcccggtggaacatgtccatcacctcagacgggcctcgtttgccgtgttccacgtcggagagcgcctgttccatccgtgcggtgagcagcacgtccttcaggcgtggctccaccacgtcggtgaggcgttcgccttccgtggtggcgtgcaattgccggcccttgcgttccacgagtttggagcgcacgagcttttcgatggtgtccgcgcgggtggcgggtgtgccgatgccgccggaatgtgattcgtcgtcatcgagtgccgccttgaggtttttgtcctccacgcaccggctcgcgtgctccatcgcggccagcagcgtggcctcggtgaacggtttgggcggccgggtctcgccttcctcgaccgtgaccttcccgaccgggcgaatgacgccgccttccatgaggttcgatgggatcacgttccttcctcccgccgggttcgcggtttcctcgtcttccggttcgggcccgtggccggtttcgacggccttccatcctgcggatacggtctcgtcggaacgactggagaactccctgtcggtgtcgtcggaaagccgggccttcacctcggtgacgatgtgcacatggtcgtcgcccacggcctcccacatgcggcgcacgatgcgtgtcatcaccttgcgctcgtcatcgtccaggccttccagcttcccggcgtccaattgcatggtcggcagtatcgcggtgtggccggccaccttcgcgtcattgacggccagctccgggcgcgggtgtccgggtatgccctcgcgggtgacgaacccgtgggcgagacggccggattcgaggagcgccgtgagcgtttcgaggtcgtcatgcgtgatgtaccggctgtcggtgcgcggataggtggcgagtttgagttcgtagaggtgctgcaacgcctggagcgtgcgcgcggcggtcatgccgtgcaaccggctcatgtccttctgcaatccggtcaggtcatacaggcggggcggccggtcgttcacccgcctccggttcacggacatgatgcggaagcggccgcgttcggcctggccgcacagcagcatcgccgcatccttgctgtcgatccgttcgctggagagccgccatccgcccatgtccgcgatcacggtccagaacggcaccggtttgtggttcctgatctgccggtcgcgttccgcgatcatggcgagcgtcggcgtctgcacgcggcccacgctgaaccgtgcgttgtagagcagcgagtacgcgcggctcgcgttcatgccgatcagccagtccgccttcgacctgatctccgccgaccatgcgagcccttggtattcggattcgggtttcatcgcccgccacgcggcctggatggcctccgcctccaggctcgccacccacaggcgcagttccggcttgcgcgagccttccatgtccgcgatgcggcggaagatggcctcaccctcgcggtcggggtcgcaggcgttgacgaggcaatccacatccgcgcgccggatcaattgcacgatctgccggtagcgggagccggcaccgcgctcctcgctgatcttccaccgccaatggccggacgggtccacaggcagcgtgtccagactccatttcctccaatccctgtccttgtagtcctcgggcatggcaaggtcgatcaggtggccctgcgcccatgtcacgagcagctggccgcactcatagcatccgtccctttggacgggcgcggcgcacaacgcctgcgcgatggccgtggcgaccgatttcttttccgcgatgacgagcttcattcttcgttcgcgttccttccgttttttgggattccttgattcttgtccgacatgcgaggaccggcgcgggaatcccttcccggccggccctggatggaaaggcgtcgccaaggtcaggcggcgaagccgagcagcggcgcgaacacggcggcgatggccagcaccgcgatcagcatgaggatgacgccggcgatccacgcgatggccgtcaccagcgtgcggctccaggtctgtccgccggattccacgatcatcgggctgcccatgcgtttgccgatgatcgcgcacacgcccgaggcgaccacgcacaacagcacgagcaccacctggagcatcccgttgagctcgaccagccacgtccacaggcccatgaaccagccggcgagcatagagagaaacgattccattgattttcctttcacctgattggaacgacgcttccgattctcggccgcaaaacggccggccacggggcacggcgtctacacgccccgccttccgccatggggaatgtagacgccatgccccgtggaacgcgcgacgggaaggcagactcgccttgacggaaaaacgagcgaaaggaagatcgtcgtggcgaacaaccagaacaccatgcgcgacatgaaacgcagcatcctcaaggcggtgcgcgacagccagaagacgaaacaggatgcgatggacgagtacgtggcggcgcgcgtcaacatcaaatcattggaggaacgtctggaagaggcccgcgagaaggccaccctgctgcgcaggaaggcgaaggacgcgggaaacaccagcgccgaactgaaaacggcggacgacctcatagacgcgcggtggacggggacggaagacgggtcggcggaagacgggtcgcccgaaaacgcggatccgggaaccgtgaaccccgagcgggagcatccggccatggaagaaaacacgcaaggcggcatgccgggtgagccgaaccgttgggaaggcggtgaatcgtgaaccggccggaaccgcgtccgctgccgaaaccgctgcgcgtcctgtgcctgttcgtcgccgcgctcctcgtgtgctcgctgggcgtcatcgtcgccaaccaccagccgtcaacggccggcgacgaccacggttccgcgacggacgcgaaacaggagtccacgggcaaaaggaaaacggattcgggcccgcgacggcacgccggcctggaggcggcgggaatcccggttcccggcgactggtctcagcgcaccaccgcgttccccgttgacacccacaaggacggcacccgcacgctctccgaaaacgcggacggcatcacgctgcacaatggttccggcccgatcgacaccgcattggaaacggtggacgcgctgctcgatccaaacggcagcgacgacgaatggcgcaagaacgtgttcgcgctgctcggcgacgacggtgccggggagagccatccggtctccgacgcgccgcgctggtggtggacccagcgccgcttccacgccggatccgtatgctcgggccaatacgatgacaagtacgtcaactacgcctacacctgcacctccgacggcaaatgggagggctcggatacggatgccatccagtcccagccgttctggacgacgaaggaaaccagcttcccgatcccggaaggcggcggaccgtcatccacgacggatccgcagcagaccgtcagccaggcgtacaacaccgtgctcttgccgatggacgacggcaactggcacgtcaccgtctactgcccggccgcgctcgacgcgtcattgctggacaaggatgccaacgagctcgaccccgatcaggtgaaggccggcgacgaggcgtacacggtgatctccgccaccggatacggcacggtccagcatccctgccggaccgtggaggtcgtggtcggcgggcagaagcccttctggtcgctgaggaacacgcaatgagccgggccagccgccatcggatcctcgcggccatgctctcggcgtgcctgctgtccctgctcggcggatgcacgccgttgaccgtgctcgcggtcctcggcggctgcaaggacggcggctccaacggatcgtcgggaggcgtcacgggaagcgtcacgaccggcgaggtgcgtgacggcatgaccatcgcgcagaccaaggcgtggttcaacggatccgacgggcccgacaacgtgtgccaggcctatccggacgggcaatgcacatggtgggcgtgcatgagaggccataaaatcggattggacgtgggctcctactggggcaacggcggcgactgggccgccagcgccaccgccgccggatggaagaccacccgcaccgatcccgtggccggcagcatcgtcagctacccgcccggcgtggccgacgcggacaccctgtacggccacgtcgccgtcgtcgaggcggtcgaccggacggccggcaccgtgaccatcagcgagatgaacgggcgcggcggcctgggcatcgtcaaccaccgcacgcacaggatcaacgtcggcgcggtctacatcctgcccaacggcagtgtgtccaccaatggttccgccggcacggattccacgtcatccggttccgaatcgtccgattcgtcgtcatcgtccgactcgtcctcctcttcggatccggtggaggcggcatggacgtgctccagttccgactcgggctccacggacgtggtggtggactacgacggcgacggcacccacgccacgccggaacaggcccgggccatcgcccggaagatgatcgcctcgtacaaggactggggagacggcgactatgacgcgctcgtatggctgtggaacaaggaatcgggatggcagtggaatgccaccaacccgagcagcggcgcgtacggcataccccaggcgttgcccgcgtcgaaactcgcctccgcaggagacgactggaaggacaacgccgccacccagatcaaatggggattgaactacatcgccggccggtacggcagccccggcgccgccaagacgttctggctcgcccacaactggtactgaggggcgggacacgtaaagggaccgagcatcaaatctcggcggaatcatctgccccgtagacgccatgccccgcgcgaccgcccgtatgggctgatgatcggagccatgcccgccggacggcgcggcaccgatcatccaagggaaggaaggacgcatcatgctgatggaacccgatgaatacacgtcccaggaacgggccctgaccgacaaggcgaaggagctgatcgagcagcacgagctcgactggggcaacggggaatgcttcatccaacgcgacgccggccacagcgaactgtacatgacgctggaggcccccaaccacgccacggtcacggtcacggtgccggccgaggcggacgagaaggggctgaggcgcgccatggcggacgggctcctcgacttcgaccccgacgaggagttcgacgaatgctggtcccgcgagttcgcggcacgcaacgggttcacgccctccggcttcctgtccggcctccaggaagacaaagcgtatttcggtctccgatctgaggcgttgcttcatcccggtcaaagcaacgccgggcaaggcaacgaaacgattgcggagatccgctggacggaggaggaccttcggcactggctgaaagaccatgactggcccgacaacaacgagaacatggacgcgatgcgcgacatgatctcggccagggaattgcgggaccgcagcatcgaggagggatgggagatcatcgacgcgatggtggacgacggccggctcgcccgcaaagacgaaggcgagaaggccgaaacgtccgaaacctacgatcccgcgaacccggccgacccgttgagcattgccgatacgtctgcctcggccgcagccacacgataaaagacccgagcgaaggagcatcatcatggccggattgaaggactaccagatcagcgtgtacgtcgccaacctgggcaaatacgcggagggcgtgttgcagggcgcgtggatcacgctgcccatgcccgccgaacgcttgcaggacaccctgaagaccgaggtgggattgggcggccggtacgaggagtacgcgatccacgactacgagggcggggaaggactgctcgccaccgtggcgaatcccggcgaatacgagtcgctgacggacctgaacctcatgtgccgcgcgttcgaggcgcgcgaggacgacgacccggacgtgtacgagaaggtgcggacggtccgcgacgatcttgacgcggtcccgcgcaccccgttgcagtacgcgaacctcgcgttgaactcggacgagatcccctatcactcttatgatgcgccgtcctcggccgaatcgaaggaggcgaagtatgcctggaccgccgtgaaccatgggtgggcatcggatgccgtgcgatccatgttcgatacggggctcggctatctgatcgatatggagatgtacggccgggacctcaagctcgacggcgatgtgtcgcttggcgacaacggctatctggaggacgcggactggccgagcgatatcgacggccggtactcgcgcgaggagatcgccgaggaggtcgaatggctggatgatttcgacgcgaagaccggttcgccggccgcgttcgacctcgcctcgctcgtccagccgggcgaacgcatcgcggactacacgatttccggcaccggcacgaactggggagccccctcataccagtgcatcgtggaggagggttccaccgatatccatgccgcgcttgaggacacgatgcaccggatcatcgacgcgcgcgccgctactggcgacgccgtggacgtgctgcgcgagaccatgggcgcaatgcccgcagcgtccgtcggcgaagacgacggcgtgagcccgatcgaccttgatctgggatatgtgctgcccggtgccgtcacctcgttcgcggaacgcgcgcaggcgtgcgacccctcggacccgctgaatatgaccgatacggccggttccggcctttccaagtgagaaagggcgagcgagatggccttgacgccttttgacatggagggtgtgaaccgcgacctgctcgcggccgggaatcccgccaagcccgacatgcaatccatcctgcgcaggaacgcgcgcgatctcgtgctggggaacgcgattctggtctcttccgtcgatgccaaggaattggagttcggcgtccacatggcgtattccgacgcggacggcggcttcgacaccgatccgagcgaggacgtgtggttcgaggcgtcctcgctcccgattcccaatgaacgccctgatctgcctcccgacaacgcgctcaggatcagggtcacggacgtgctgaccgaatacgggttcacggacattgacgtgaaagccccggacaggacgccggaaggcatctggatcggtttcgaggccatgcagccggtcaggctcgacgtgacctcggcccggggagggcgttccgtttccttcaccctgacagcagccgaggccaacgattggcgttccggccgtctcgacgcgcacggcctctcacgcatggccgtcgaacgggttctcgccaggccgggcgacacggtgacgctcgcctacggggattcgctgttccggccggcggtgatgtgcgacggttcgggaaggcttcccgagcatcgcgtcaaggccggtatcggcacgttcgtcatcggccgtgaaagcgaggcggtcatgcccgagatactgcggatcgaccgcactgttgacccacgagacccgctcgtgatcgaaaaggcgttcggaaaggagcacgacatggagaacgggaatgtccccgaatactggaaaggcctgatggacgaggccgatctgccgttggcgggcatcgtgcgcgagcacggcggcgggttgatggacttccaccgcatgaagggcatcgaacgcctgaccggttcgagtgactgggatttctactcctggacggtggaaaattacgacgatgacctgctcgacgtgtgcgaacgggagaacgccgccgacgtgctcgccgacttgcaggcatggtggaaaacgagccagcccgacatgcggcaacacgtggacgagatgatggcgggcatcgacgcggccatggaaccgctcgacaagcgcctgtacgccgccgccgaaaaggagttcaaggagcgcgcgttggacccggacggggaatgctaccaattggacggcggcacgttcatctcccaggaatcattcgacggcatctgcggcgaccaacgcgaccgctacatggcatggaagaaccaggccgaacccgccagactcgtgagcgcatgggacgaccccgcacgcctggaccggctcgtgggcgacctgatcgacgcggacgatggcggcggatgcttctacaccgacgcgcagcccatcgactacacgcagggcatggattacagcccacagcagctggccgcagacagcgggctgggagatacggtcccgctggcgtgtgagtccaacgcttcctacagcctcgcgcaccaccccgatatcaaattcaccgccaccgggtctcccgacggcagaaaggcgctggaggtctcggctcccggttccgcccgtcatgcgctgatcacggccaaacccggaacgttcgacgtgagcctgcatgacgagcgcggcatcgtgtccggcgaatccttcccttacgaggcaaacgattcctggacgtaccggctttccggccaggcgttgcgcggcgcgctggacctcgccgtcggctgggccgacccacaggaaacgtctcttgagaccgcagggctcgacctcgcgttggatgacggcatggaaacgacacacggccgctgacgccgtacggcaacgacgaacagaaccaaggagcacacgatggacatgaattggatcgacgagattcgggatcccgaaccccgcaaacggtacatctacaacgctgacgactacgacccgcaatacggggacccgtatcaccgtgaacacagcacccgcgccgacagcctgtggcggctgtacgaggagagcggcacgtcgatcacgttcgatgccttcgcggacgaatcccgtcaaaccgattacaggatggagaccggcgctctgcgtgatttcttcaatggatcccagtcggcgctctcctcgtacaggaacccgatgggaggcaacccgctgatcgcgttcggaagcataggccgatgggacggcgaacgcacgggcatatcctcgttcgagaccttcgatgatctgatgaacggcgatgattccccgttcaaggactgcgagatcgaccacatctgggacgagaacggaatcctgaagatgcgcggccaccaccacgacggcagtgtggaggtggagatacgccagctcaccgaccagggatgcgaggcattggaatcctacgaacaggcatgggctggcgaaccgttcgacgccgcaggccgccactacgacggcggcaaggaatccgtggaccgcttctggaacgacctgaaaaccgatcggggcctgtccgtggaaccccggtacgtggaactcgcgttcggatgcccgcccatcgaatgggacatcgatgccagggtgagggacttcgccgaacgcatgggcgacgaatatacgagcctgtacgagcaggacacgaccagcatcaagggcggtgatttcgaacgtttcggcgcgttcgcggacaatcacctcgacttcatacgcgccctgacgaaggccaggggcatggaccccatcagcagcgaccgcgagataggcgcgttcctcaacacgttcgacaagctcgccgcgatgcccgaaccgacaccggcgaaacaagaaaaagacgagctttccgccggcgcatgcgatccggccgacccgttgaacctcgaacagtcatcgtcatacggcatgacccggtgaacgtaagaaacgacacggataagggccatggaatcatcggacgacaacgatgattccacggcctttttccaggactttctcgaaggcaagaaaatcgtcggactgtccatgtgacgcgcctgcgcttgtagacttatggaagcatcgattaaggagccgatatgccgaatccagcgctgactgagaaaatccgaaaccttcctcctctcttggactctctggagcgggacgcggaggtgtccgacttgcttcgtcgttccgatgccgcccgagaacggttcaggcagatgtttcctttggatggggtggagcagtcagcgcttgaggattaccgtaaggaatggatggcccgctatgtctacaactccaacgcgatcgagggatccacgctgacgcttgaggacaccgaactggtgttggagggcgagttcgtgccgaccgactcgccggcaagatacatcttcgctgcccgtggcgttgcggatggcatggcctatgcggaacgattcgctgaagaggagcggacgctgagtgtcgagatgatccaaaagctgcatgaagtcaccgcattggacatgcagcccgcgctcaggggtcggttccgcccctacggctaccaggcaaggatcaccgccacccgagtgaagaccgccgacccacttgaaatctacgaggacatggaagcgctcgtggacgcggtgaacggttccaaagaccacccgatcctcaaagctgccggattccacgcgatgttcgagaacatccatccattcacggacggcaacgggcgaaccgggcgacagattctgaatctcatgctcatggctgccggctaccggcccgtagcaatcaaacatgatgccggccgcagctatgggaaaagtctggaagcatggcaggttgacggcgatcccaagccgttcatttcccagcttgtccaatgcgttgatcaggaagagcgcgccgtagcggaaatcgtcggcagattaagagagaaccctttctcggaaaacgccatcgacgggattggtctcgaagacggtccggcacgagggcgttccctctgattggaacgcttcaggattgtgataggtgtacatgaatatgcgtttttacatatattcatgtacacttatatgcatgaagaggagcgaggcgattgatcagctgcgcgagatggatgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcggacgcaacctcgatctggtggacatggacgaattggaggacgacgatgactggaactgacgaaccgttcaagtacaaagccatggcagcacagatcgtttccgccgaaggcatgggcaatctgcttcccgtggtcgagaaggaacttctgcattatcgaatctgtttgttcatccgatcctcgcggtgctaagggaataggtggcgacgctgccggctgttccgacgacctggttcatgggcatggtcagtctcatgtcggtgcgggtggtggattccacggcgttgcgcatctcgtcctgcacgaggccgatgtaacgcatggtggtggcgatgttggcgtgccccagcatacggctgacaagcacgatgttgcagccgttcctgtagtagacgcatgtggcgaacctacggcgcaggctgtgcgacgggtatccggttaccgtcttgatcctcttcgccacgtaatcgacgccgcagtgtccctgcacgtctccggggaacagccatacgccggtgcgtttccgcaatgccgaagcgagctttgccggcacgggaagcatccgctccttgttgcccttgccgtggacgtggagcaccatgccctcggcgttctcctccagatcggtcttcaggttgattctggtcatttcgatgcggcgcaggccgcagaacgcgcccagcatgacggccagccgcgcgttctcgtcgggtgatgcgagtccttgttcgatgttctcctcgggacagatgcagccggacggaagggtcatgggcacggtgggcacttcgtccgccggattgcggcgggcgagccctcgcttcatgctccattggtagaagaccttgacgcagctgcgcactccgcgtctgccttcggttcccatgccggctaggtagaatatgaggtcgtcttcggtcacgtcggtgatgcttttatcgacggctttggagaatcgaacgatctggtaccagcgggtgcgcagggtgtcgttcgtgcgtccgatggcgtccatccagtcgatccatttctcaatggattctttccaatcctcccgtggctcgacgtgttcgcagctcttcctgttgtcgttccaatacctcatggggctccttaagcgcatagaaaagggaagtgacttcttcatcacttcccaaggaatactattgcgcgtttctggccgatgctcttcggaaaaccagctgcaaggtgaacatgcgcgatgacacgccgatttgaaggaacagcaaggctggtgtattgtctactcctgttgcaaaaagccctacggctgcgagccagaaccgtatatcggacggtcactggttcaagcccagtcgcaggagctcacctgaacgggtaactccggtcgggatgaaaattgaatattcctgcgtagctcagttggcagagcatccgactgttaatcggacggtcactggttcaagcccagtcgcaggagccatcgaaagcctcggttctccgaggcttttttattttcatcgcattggtgaccagacacgacaccccatcatcaaccgggaaatccatggcgaagacctcaccactactcacatcaggcagacaggtcactgtcaattcaccgatgagaggcgcggtattcccagtatcagtttgggaataccgcgcaaatcttacatcgagaccttggtcaggggcatggcggagtcgatcgggaagtcgggggcgctgggggccacgccggcctcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggaggcgcacacgtcgtccaccggaatctcatggccggcggcctgctcgctttccacccagcgagccacggcggtcttgacaccggagaaactgaaatcatacgggtgcgcggcaccggccttgccttgtgtcaggcccatcggcaccttgatggcgtgcgggtcgccgttctgaccatggcggtcgatgtgcgggccgcccggatacgggaagccgagcaggcgggcgaccttgtcgaagcactcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcggcgagcgccttggacacgcatggcacgaaggcctcagcgtgcgcacgggaggcgatttcggggatcactccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatatagggccagcgcagggtcgttatccacacgcacttcgagcagcatgcgcgaggcgccctgacgtttcgcctcgtcgaccagtgcctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggcgggcgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggacgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggcgcatggcttattgcaggtcgaacgcggcccatcgcttgccgactgggacgaatgcgacggtacgagtgccgttgctggtgagttcgccgtctgatccagcggatgcgatatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgcgccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcagcgcgatgggatcggtcccttgttccacagctgcacgcatcatgacgatggcttcggcggttttgccttccacggccttgtctgccacggcaaaaccggtgacctgcggattggcggtcaaatactggttgacacggtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccagagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgcccccatctcgccacacaggttggacaatgacctgccggcataacggcccggcagcactccgcgattaggcgtatgcctcatccaacagggcgtcgatatccgcgaaacgcttgggagcgggacgccataccgggtgaccggccgcgatgaccagtgccgggtgttccaacgcgcgcaggtcgtccagcggattggcattcagcacaagcaaatcagcggatttgccgacttccaaagaaccggtctcggcatcgacgccgagaatggaggcgttgacggcagtggctgcgtgcagggcctcagccgggctgaaaccggcgtatgcgaccagcagctccagctcacgccatgtggcgtactgcggcacgaatgtcatgcctgtatcggtgccgacgcctatcatcaatccggcctcgtgcgcttgacgggcacctgaaaccatgcctccgaccacgtttttggaattctccaattggatgtcggtgatgccggtcgcgtcctgtccaagcaaggtcaggggaaggccggcggaaagtgtcggaaccagcgccgagtatccgcgcaacgcattcggattgtgccggaacatgccgatcaattcgtcgtcgagcacgctgccgtgttcgatggtatcgacgccggccagcagcgaacgccgcacgccttccgggctttgcgcgtgcgcgccgacaataacaccgtactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggatgccaagatacgcggtccgaggatttggcctgcatcaatctgatcgcgtaatgtcacgacttcatatcccacgtcgccaagcgtgcggatcgtcgtaacgccggattccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatgatggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacatgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgctccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattttccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacgatcatcgccgccacggcagcacatgacgccactgttataggcaatattcgtgtgacaggccattccatgccgattatggtgacgtcaatgccagctccggcatcggcctttgcctgaccggtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgattgactgatgtatacccgccaatcgccgtgcgatgatcaatgatccgctgagcggtaaccggcccaatacctttgatggattgcaattcctcagcggtagccgtgttgaggttgatgagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctcccctcagtctcgctacgcgagccagctcccctcaaagaggggagctggctcgcaacaagtcactccgcgggaacgatggagacgatcttcggggccttgacgatcaccttgcgcggctccttgccgccaagacggtcggcgacggcggccagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactcggcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacgatgaagtgcacggaggcaccatgggattcaccgatccagttgcgctgcatgagcttgaccttctcaggccagttgatgccgtcaagatcggcgatgaggcggtggccgtacttggtgatgcgcatggaccactggcgtagctcacgctggaagaccgggaagttgccacgctcggacttaccttcggcggtgacctcttcgttggccagcacggtgcccagacccgggcaccagttgaccggggacttggagatgtaggccaggcggaagtcgttcaagatatcctgctgctcggcgtcagtgaggtcggaccactgcttgccatcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataactgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgagcctgcgggtggttgccgcggaagatgccgactgtctcgtcacctttcactgcgcacaccgtgccgtcgcctacgtcgcccaccgaacctgcgtcattggtgaatcggccacgctcatccgacctgaccagcaaaccgacgctggtcgtgaggtatggtccggcaaaatcaacgatcgcactggacccatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggttcgtcggctgcgaccccaatggcgatggtgggcccctccggcgctccggagacggtggtgacttgaatttggccgcaaccggccagaccggataatggcaatatcatgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgtgtgaggaaccaggcaaccgcaccggaaagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttattggacacgatcgaggcgaaagcgtcggtcatgttcgcaagaacgccgctgtagatgttggccatctcgatagcctgcttgttttcggtgatgacgtcgtcgagcaggtcctcgtcgtccgggtattgtttgatgcgttgcagggtggtgagtttctccatcacgatttcgttcgatttcagcgatgtggtgaagtacaccaaggtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcgcgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgcctcacccgccttccgcgctttcctactgttctatcgctgtacggttccaaaccgagattagtctagacccaccgttcgaatttgcgagcggggtttcgcatagcgaccgtcaccagacgattggctgccaacttggcatgtgcggtcctcgcagatcggtcggcccgttctcccagtcggcgctgtcggcgatggcgggagccttgttgtattcctccaactcccacaggggctgttcggtgggggtgccgttgacgctgtggcgcactttgagccggcaccagcaggcgttgcgcatgccgccgagtgcgttcatgccgtccgggtcgagttcgagcaggttggagatggtggcggtaatccatgagccatgggtgacgagcatcagcgtggtgggcgtgctgtctgaataggcggagtcggtgaccagtgcgcgcacggcatcggcacctcgctggcccacggcggcacggctttccacaccatgcttggtttcgcccccggtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccggcggcgggagcctcctcgaactgtcgcgtatcagtgcgttcggcggcgtcaggaccgggctgggcgatggcttcgggatgctcggcaagtcggttcaccttggcccagtaataccgtgaagcgagtgcgaatccggtctggtcgacctgccattggcctacgatgtcgagcggcacatcgatctggccttgcaagcgatgttcgagattgtattgcgtacggccatgacgcagcatcatcacttcatcgatcatcggttttcgccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcgacgtggatgtgccgttcgcgctggagcagattgccggctggcagcgcgcttcactcaagctacctgactgggcgtcccatgatgggctgattttcccgccgcaagtcccaatggaacaatgttccagccaattcaccgcacagtacaaggctcggctggcacagcgattgttggccgaggaagcagtcgacgacgattccccgacatccctagtcgatctgaccggcggtttcggcgtcgacttttcttacatgtcccgagtgtttgaccatgccatatatgtggaacaacaatccattttatgtggtatcgctcgccataatttcccgatactcggccttggccacgccgaagtcatcaatgatgattcaacagcagtgcttgatacgcttggccgagtctccatgatcttcctcgatccggcccgccgtgacgatcatggctcgcgtacctacgcgattgccgattgcacgccggatgtgctgaccctgaaggatatgctgctggccaaggcaccgacggtcatggtcaagctctcccccatgctcgactggcataagaccgtcgccgatttcgccggcgcggtgcatgaggtgcatatcgtctccaccgggaatgagtgcaaggaattgttgttggtgttggggcgcggccgttgcgtctcaccgctcgtggtatgtgctaatgacgggcaggtgctgtcgtacaaggccggcgataacagcgacaatcacacccctatcagcgattctgccttggttgcacgcaatacttgcaataccgaagactccctgtctgaggaaagcgcgaacggcttcgattcctcgcattggaagtacctttacgagcccaacgcctcaatcatgaaggccgggtgctttgatgttctcgaacagcgcttcgtcgtgcatcacatcagcccgaatagccacctgttcgtggcggccgaacctattgccgattttccaggcaggtcattcgtcatcgaatccatcgtcaccatgaacaagaaagaactgaagcagctattggccggtctcacgcacgccaacatcgccgtacgcaatttccccctatccgtggcccagctgcgcaaaaaactcaaactcaaggacggcggcaacacctacctcttcgccaccaccgacgcccaaggccgtcacctagtactgcgcactgaaaagcgaaaaagtggctccctctgacgaggaagccaccaatacgtcagctaatcagtccttggcgatggtcttgccggcggtcggaccggaggcaaggttctggatctcggtgacttcgagaaccggaatcacggccggcttcttggtgcccttttcctcggcgatcttgacctgctcgttgtagatgtcgtcgtcaacgtgcagcaccacgttgccgcggaagcggtagccctgcttcttctcgaggttggcgaaggcgatgaccagcggagagccgttcttgaggttctcgtagtgctggccggcggtgcgctcgtggtaggcgatgtgcgtgtcgtccagcacgaacagggacatcttcgggccgaggtccagttcgccgtccttggagacggtggtgatccagccgaggttgttcttgatgaattccttgatttccggagtaatgactgccatgtcgaatcctttcatgattgctacggataacgtatccttactctttccagagtaccggtttcgagcgcgactagcccggatgttcgctgtgagtaacctcaccttcgcacagctttcatccggttcttacctgcttggcgatgccgcgccccggccgcgcaccagccacacacctgtcacacacccgacgcccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcagctttcccccgaatctcgcccgactcatgttgctgggctgcgctgcattatggggtggcagttatctgctcgccaaattcgccatggaggcgattccgccccaatggctgatgggtctgcgcatgataggcgcctgcctgtgcatgctggccttgttccataagcacatcgtgccgtatctgacgccgaagatcattgtgccggcgctcgtggtgggtctgacctactggggcacgatggtcacccagaccatcggcctgcagaccattgaaccgggccgcagcgcgttcctgacggccgcctactgcgtactcaccccgttcgccacgtggattatttcgaaaacccgcccgaaggccatcaatctggtcgccggcgtgatctgtctgatcggcgtcggcttcgtctcgctgaagccgggcggttcgctgtctctgagcgccggcgactggctgaccatcgcaaccgccgtcatcttctcgttcaatctgacctgccttggtgtctacaccaaacggttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgccgtcacgttctccgcgttgttctggggcgagacaatcatgtggacttcgctggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctggtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaagactccacatccggctcgtccaacgacggcaccgattcaagcacgtccgactcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgagggcagcatcaccatcaacctgttcgacgacaaggctccgaacaccgtggccaacttcctgggcctcgccaccggcgagaaggaatgggcggacccgtacaccggccagccttcccacggcaagttctacaacggcctgaccttccaccgtatcatcaagcagttcatgatccaaggcggctgcccgctcggcaccggcaccggcggccctggttatgagttcgacgatgagatcgatccgagcctgaagttcgacaagccgtatctgctggccatggccaacgctggtctgcgccgtggtatggacggcaaggtgcacggcaccaacggctcccagttcttcatcaccaccgtgccgaccccgtggctggatggtcaccacaccatcttcggtgaggttgctgatgacgcttccaagaaggttgtcgacaagctcgaggccgtcgaaaccgattcgatggatcgtccgctcgaaccggccgtgatcctctccgtggacgtggctgagtaagacccaccacaaccgataacaaagccctctgatcgattccaatcagagggcttactcgttctcttggctcccctctggaggggagccagagtacggtacggactacttcatcttgcgcatacgcggctcggcggactccttggcaccggtcagacggtacacgtcgaacacgccgtcgatcttgcgcacggcggccagcagcgtgttgagatgctgcggatcggccatttcgaagctgaactggctggtggccacacggtcggaaccggtggcaatcgttccggagatgatattcacgccatgatcggacagcacgcgtgtcacgtcggacaacaggttgcgacgatccaaggccccgacctggatcttgaccatgaacagacccttggtgctggtccattcgacctcgaccacacgctcggactgcttgttcttcaggtcgatcatgttctggcagtcggtgcggtgcacggacacaccctgattgcgcgtgacgaagccgatgatctggtctcccggcaccggcatgcagcaacgggccaatttgacccacacgtcgcccacgcccttgacggacactccggtagagctgctggaagttttgcgctcgatgggcttgagcggcagagcctcctgctcgacctcctcatcgacctcgtcggccccggcatccttgaccagatgcgagatgacgttctgcgtggagatctgcccatcaccgatggcggcgaacacagcgtcggcgttcgggaaattgaggtcgtcggccacaccgatcaatgcctcggtggtcagcagcgcattgaccggcaagttacgtttgcgcatagcgcgggtcagttcgtcgcggccttcctcaatagcctcggtacgacgttccttcgagaaccactggcggatcttgtttcgtgccttcgggctcttgacgaagctcagccagtcgcgcgaaggaccggcggtatcggacttggaagtcaggatctccacggtgtcgccgttgtcgagcgtggtgtcgagcggcaccaaacgcccgttgacgcgcgcgcccatcgtacggtggcccacttcggtatgcacggcataggcgaaatcgaccggtgtggcatgggccggcaaagagacgatcttgcccttcggcgtgaagacatagacttcggacgagccgaggtcttccttcagggaaccgaggaattcgttggaatctggggtttccgaagtccaatcggcaagctgctgaatccatttgagattgtcggcttcggaaagctcctggttcttctcgtcacgcctgcggtcggacttgtccggcgagctcaaggcgcgcccggcctgaccgttctccttgtacttccaatgcgcggcgatgccgaactcggcgcggcggtgcatgtcccaggtgcgaatctggatttccaccggtttgccgcccggacccaccaccgtggtatgcagcgactggtacatgttgagcttcggcatggcgatgtagtccttgaaccggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagcaccacgatctcgttgtagatcttcgggtagagcaccttgaagctcagttcctcgagctccgtcttgatggcgttcataccgagtcggttggccaaaggtgcgtacacgtcaagggtttcacgcgcctttttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacctcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccaacggatggatgatgtatggttcgcccgacttgcgccgttgcgtgcaatgctggatgacggcgcgccggtacgcgcggtcgagaatggacaaatcctcatcgggatgatgggacttgcataccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcatgcacctgttcgccatcattggttccgcaaccgtcgttgccgtcatcaccttggtcattcaaccggcccaatccggtcaggacgccactcccgtcgaaccgaacccacgttcggcgcgatcggatccgggcagtgtctcggccgggatgaaccgggcctcaacataccgctgaatcaccaattgagcgatgcgatcgcccggatggaagacggcggtgcgttccggatcgaggttgatcagcggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggcaccagtacccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttattgcggggggaatcataatcctgagccatcatggtcctttcgtcgtctttggttcgtaagtcgatatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtacgcgtgagcaagacgggggacctcgtattctccattggcggcagggaaatggccgtgagcgtggacgacacgctcgaacgggcgattcttgaggccaagcaggtcagaagcgagacgcgacaggccccccagccgcatcagcagtccactttgccgatttcccagatacagtcgctgattcgcgccggtgccgatccggcccgtgtcgcggagaaatatcatctgagcgaaacgctggtacgtcgtttctccatggccgtggagaccgagaaacagtacgccatcgaacaattccttgccgtggcggcacccaaagacagcagggtgcgcaccatcagcgaactggtggaacgcacgctggcctctgctggaatcggcatggaatcagtgacctggaaatccacccggcgcggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcctgaactgcccggcgactccgtacgttccgcgcgtatcgagcgcgccgtgtctgcttgggcggcgcctacgccttcgattccggccgcacggcctgccgcgatccggccctccgtcacttccacaggttccatgcccccggtggacctatccacgtccatctcaccggccacgaaccaggctcatgacgctacggcccccagcccggtctcttcgcagaccgccggacctgtttcgtcatctgccgcaggattgcagcaatcgcctgccacggcaccagagcagggttctgacaatatttcggacgagaccgtacggcgtggccccaatgcacagctggtagccaccgagcaggagcgggcggccgaatccgccgccaccaaacacgaggcaccagccaaaccggccaagcgtaaatcaggacgttcggccgtaccaagctgggacgagattctgttcggagactgaatttccgaatcaggccatatcgatcaggcagggaatatccatttccaatgccgtttgggagccatgcacgctcggcaggtgggtggctttgtctccttgcgtacgcgaatcgacgagggtcacggctcccgctgcctgcacgaccacatcgccgagcatcggccggactcgctcgcagaccggtccaaacaatccgtccgcgatggcctcatccctggtccgcaccaaggctcggtcttgcaggtaatcgcgccaccggcaagctatatcttcaggtcgttcatccggctcggcatacagcatcagcgagcgcggctctcccccgaccagtgacacgcctcgggtgagctgcggttcaacggcgatgtcaatccgctggcccatgtcggtttgcaccatgccgtggtcggccacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcatccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctatgatccgcgcacggtcaaggagcatatcgtcgagacgccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaatctgactcccgaccgcccgtatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccggccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgttacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagcgaatatcgcaagaagaaggcgctggaacgcctgcacctggtcgagggcctgctgctggccatgctggacatcgacgaggtgatccaggtaatccgcacctcagatgatgcggatgccgcgaaaagccgtttgatggttgtgttcgacctggacgaggtccaggcccagtacatcctcgacctgcgtctgcgccgtctgaccaagatgaaccgcatcgaacttgaggccgaacgcgatgacctgaagaagcgcatcgaggagctgacccgcattctggcctccgccgaagcgctcgaccatgtggtcaccgacgagatggacgaggcggtcgccaagtggggctcgccgcgtcgcaccgtgctgctggacgccgacccggatggcacgttgacgccggtcgtggcgcagggtgccggggcttcgggtgtgtccaagtccgcgctcgaagcggtgaaggccgccaccacgatttcctccgccgaagccgatgtggccgcagccgcagccgcagccaagaagaccggcgaacagtccgcgctgaccggagccttgaagatcgaggacgagccgtgcgtggtgatgatgagcgccaccggtttgattgcccgtaccacgccaagcgcgatggacgtgttcaatgtacggtccacatccgatgaacgtctgcgagacgatcaaatcaccacaatcttcgagacctccacgcgcgccacatacgggctggtcacgtcggccggccgcctggtgctcgcgcatgtggttgatttgcctgccttgcccgctgccgccacattgtcgctgaagggaggagttcaggccgacgaactgatcggcatgaccgaatccaccgatccgattcgtggcgagcgcgtgattacggcgattgccatggagcagccgacatccggcaaggccagtgccaaggatgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgcaccgcgggcggtatggccggcatcaagctggccgagggcgcccgtgtggcggcattcaacgtggttcccgccggcaaggtggcatggacctatgaagagggcgagaacggcttgacttccggatccggtgcagtggtgctcaccgtggccggcgactccgatgcactacccggcaccgaaaacggcgccgccaaggtcaccccgctggaaatgtaccccaccaagggtcgcgctaccggcggcgtgcgttcccagcgattcctgaagggccagaacacgctgattcttgcctgggtgggcctctacccgttgcacgcctccacatccgcaggctccccggtcgagcttcccaagcccgatatgcgccgagacggctccggagtagacctcgcctcccccatcgccttcattgcgtaacctcaattaagctccctctgatgggccgagccgtaaagcaaacacccccagtggggtgtttgtaggcgaggagcgaacgatagtgagccaaacacatagagaagagaccctaaacccgacctacactaagcatcaaggaggtggcgatgagactactggttgccgtatccaatgaaccgttggcccacgccattcatggtgccctgcttgcctgtcgtcatgaggtgtccttggcaagcaccggcagtatcgcgctcgccgctgtcgccaaggagtcatttgacgcagtgattcttgatgaatccctgctcggcatttccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacagctccttcagcgcgaattcacgcgcaaacaactcagatgccgaagccgaacaacgctcggacaatgccgccgctagcacacaagctaacgtacgacgcccagatgccgcgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttatcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatatcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccacgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctccccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctggttctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcatcggcaagctcattccagaaagtgtgctcccccagttcctgttcgacttcgcgaatcacgtccgggttgagcacttgtgccatatcggtggtgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggcacgcgacggcccgggtcggatcgcggcatgaacagtgatcgggcggcgcattcgcggaatcgtgcggcaaatagcacggactcgcccacttgacgctctacatctgctttgaggtcttctgggtcgaaaaggaacaggtcttgagcaggaatatgtccgtcaccgtccggtagctgaatgacgataccgtcatcggcggcatatacctgcccgtcgaaaccgtagcgttggcgcagtctgcggctgatggccatggaccacggttcgtgaacgcggcggccgaaggggcttaacagcacgatgcgccatccgccgtcttcatcgcgtgtgcgctccacgataagggtttggtcgctggggactgcaccagtggcggcttgttgctcggagagtaggcgggccaagttggtgatggcgttggcatctaggccatcgtggtggagacgggtgaggattgttgggatgaaggttgggacagctggaccttctgcggcagacctcccctcagtccgcttcacgtctaatccggcggcgatttctcgggtgaagcgggctatggtacggctgaaaccgtagtcacggccagcgccttcaccgtgccagaacggcaggcgggcggtgcggcccggagccggagtcacgaccacacgatcacgggtgatttcctgaatctgccatgtggaggtgccgagcgtaatgacatcgcccacgcgcgattcgtagaccatttcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccggaaggccgagaattcctcgctgttgtattcgccggacatcatgccgattaccgcatcgaacatgtcacgtggcagttcggcaaacggcgcagcacgacgcactgtggcataccagtcatcagcgttcaaatcgtgcatcgcggcagcggccacggtctgctgggcgagaatatcgagcggattgcgcggcacggccaatggttctatatcgccggcaatcatggcttccagacttgcggccccagtgacaatctgctgacgggtgagcgggtagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacagatcgttcaagcgcgcagtgagtttctcagccacaccacgcgaattaacgaacaccaatgtagtgcggtgcgcgagaatctcatccaaaatactgcgttccaccacgggccaaatggaaccggaggtacggtcgcccgccgctccaaccaacgcggaggaatcgaacgcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccaatgcgctgcatatgacgatcgccacggccagcatcgacggcggcatcaccgccctcatcagcatctgcatcgattgcatctcgcttgcgcgattctgtgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggcacgggcagcccttgcgcctcgcattgtgcagcaatgccctccaaaggctgttctaggttcttggccacatcggccgcgagcgcctttaacggcgagatatacagcacacgcacaccggcacgccgcgtgcgtggcacggtcatcaatcggtcgatggctgagagaaacgcggccaatgttttaccggaaccggtaggggcgatgaccaagacattgcgaccggaatggattgccggccatgcctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcaccaagcttggtggccgcataggcggagacgtaggagccgatttgcgcggattgcagcagcgtatgaccggcggccaagccagccagcacggtccccatgaacgagtcgccgcaaccggtggtgtccactgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccaaacacagtcccaataccgcgcattcggcgatggtcgtgcgatgtgattgcacatagccggcacttgccttggcattggaacccggcgaatagacgatggtgttctcgccctcagcgctcacggtgattaccgtggtgccgctggggccttcgacatgcaggatatcggcggtgtcgacgccggcctcatccagcttgcctaataggaagtccgcgttggagtcctcgcccaccgcgcccagcaactggacattgacaccgaggcgagcagcggcagacgcctgattcgcgcctttgccgcccggcaacactttcatggcaccaccattgacggtttcgcctggcttgggcagtcgtttggtggtcacggtgtaatcggcgttcatcgagccgaccacgattaccgagcccggcgcatccttcagcgcttccaatcgttcccgtacgggctcgggcatctgtttatgttcttcttcacttatcaccatgggctccaagcatagtaggcggcgggcccaaatgcgcgcatgatcagccgcgcaacttacgaagacgctcgcgcatggccaccatcagcaccaagagcaccagcaaataccacgggtagagactgattgtcacatattgcgcgatgatgccgaacagtggcggcatgagcagtgagcccacataggcacaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgagtatgccggcgagcaccagcacttggccgaggcgaatcatgaccgggtccttgaatcgcatggtcagaaagccggaaagcgcacgccccacggtgatgcctacatagaataggctggcccagctggcggcggtgatcttgtcgatgccgctgtgcatcaccatgtagctggaggcccacagacccgccgtggattcgatggcgcagtagcagaagaacatcacgaggatttccttggcaccgcgaatggcgagcacgccggccacgccgagcggtttgcgttcagcaacagacgccccttcagcagtgccacatccctcggcattgccgtcagatgatgcggtgtcatcggtcgattcgccgaccgcaattgcgccacgtttcttccacagtggcaggctcagcaccaggatgacggtcagcatcacctgcaggatcgcgatgtaccgatagccccacggccaaccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggtccgaaagcagcgccgagacgatcgtgaacatggaaatcaccgcggagatgccgccggcccacgccaccggcacgttcagatcctggctcatggtgggccatgcggacccgagtagcgaatccggcaaccccagactgataaacgccacatagatgacggcaagcaacagactggccatgttccatctcccattcacagtacggcaccggttgtgataacgatgtcatcagtctatcgaatgactcatgggcaacacgcataaaacatatgacaacgtgctcacctcaaacgccaattacggaaattctcggtaagcacgatgtcattatcagcgacgtcttcgatcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcgggtccatggtggtgtccgccaactggtcggcgtccatctcgcccagacccttgtatcgctggatgtcgtcgttgtatccgatgtgcttcttgtcgaggtcggccagtttgccggccagctcgtcatcggaatacgtgtagatgtattcgcccttgtgcgagccggtcaacgcgatgcggtgcagcggcggtactgcggcatacacgtagccgtgttcgataagcggccgcatgtaccggtagaacagcgtcagcagcaggatacggatatgagcaccgtccacatcggcatcggtcatcatgatgatcttgtggtagcgcgactgttcgatgtcgaagctctggccggagccggcacccaccacttggatgatggccgcgcattccttgttggagagcatctgcgtgatcgacgccttctgcacgttcagaatcttgcctcgaatcggcagcagtgcctggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccaagcacgtccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatgtccacgccgcaggtgcgttcgatttcctgggcgtgcagttcaccgcccttgcccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcgacgacctggtcgccggccgtcagtgagaagtcctcctcggccgggctctcggcatcgttggacgagacatccaaggccggtgcctggtcttgcgcaggttcgactgttgcgtcatcagtggcctcgacggtgtcagtcgccgccgtttccggtacgttttcgtcgatgatggtgattttgaggccgggcaccaggaagctggtctggcgcacgcggtcgatgagctgttcgtatgagaactcggcggttttgttgaagatctccggatcataccagtagcgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcatgcagtttggtcagtacgacctccacgccggacaggccggttttcggttccttgtccaccgggatgcctcggccattgtccgcgacttccacggaaccgtcggtgtgcagggtgaccacaatgtcgttgcagaagccggccaaggcctcgtccacggagttgtcgatgatctcccacaggcagtgcataagaccctgcgagtcggtggtgccgatgtacatgcccggacgcttgcgtaccgcatccaagccctcaagaacagctaggtccttggcgccgtattcttctttgggcatacagtcctatttttctcttcaaatgcttggctcccctcacagaggggagccagatgatcattgatccaggaagtcgcgcagggtctgcgaacgggacgggtggcgcagcttggacatggtcttggactcgatctgacggatgcgttcacgggtcacgccatacacacggccgatgtcgtccagcgtcttcggctggccgtcttcaaggccatagcgcatcttgatgacgccggcctcacgcggagacagggtttccagcacctgcttgaactgttcctgcagcagggagaaggccacggcgtcggacggagcgatggcgtcggtatcctcaatgaggtcaccgaactcggaatcgccatcctcgccaagcggggtgtgcagggaaatcggttcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcgatcacacgacgcttcggattgcccgaggggatgatgttctcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtagtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggtatggcaacgctccttatccggcatcatgccttcatcctcgaatgcgcaggtcagcagctcgcccattcgtgttctcgtacgcgccagatgcggtcgcgccgcgaattccatgagccatgacttggggcaacggctttcatcaataaccaacgagagaatcagcgcatcacgaatcgataaggtctcgcgcatgcccaccgcaaacgcggccatcgtctctcggcctaggtcggtgttcccggcatcgaggcaagacagccattcgtccaatggttcggccacccagtcggcattagcctgttgcgcgcctcgaagtcggcgatcattgcgaaattcctgtgatctcgtcttcaactcgtcaaagacaaagggctccgtctgctcggcggcgtgccgtttggcgtgtcggttcttacgcggcttgtgtggcgtgttgttgttcatcatgtcctccttgactaatggtgtgcaatctattggtgttgtggtgcgcgccgagccggatagctcatgcgccgagggggtgtgtgcccactatggctgaaaacgccgtatgacgcaggaaaaaacgaccattgtggttctagcttcaaaacccttgatttccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcgttggacgccttcgatgttcttgccggcgacgtgactcctgattggcgtgacgccatgatcgacctggcctgcgccattgaagtgtttcagacggccgcactggtgcatgacgacatcatcgacgaatccgatctgcgccggggcaggccttccgcacatcgtgccttggaacaggccgtacacagcggtgccataggccgtggcttgggcctgatgctcggcgacattctggccactgcctgcattgaaatcacacgccggtccgccagccgtcttcccaacaccgatgccctgaacgaggcgtttcttaccatgcagcgcgaggtggaaatcggccaggtactggacttggccgtcgagatgaccccgctgtctaatcccgaagctctggcgaacgcctcattgaacgtattccgctggaagacagccagttacaccaccatcgctccactgctgcttgcactgctggccgcaggagagagcccggatcaggccaggcattgcgcgttggccgtcggccagccgctcggactggcgttccaactggcggatgacctgttggatgtcgtcggatcaagccgcaataccggaaaaccaattggcggagacatccgagaaggcaagcgcacagtgctgttggctgatgctctgtctgcggcagatacggcggataaggccgatctggttgccatcttcgaagcggattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcatccccgaatccttgcgatagtccacaatgcgagccgccggaccatgagaccatgaacaccggtgaaaacccgtgaaagctatgcgctgatgctccggccgcgtaaccggggccatgtacactgaacatgtttagtcgtgattaaaggaaccgtacgatacaacatgagtgagaacgagcccgcgcagatgattgagggacgctaccgcatcgtgcgcaatatcgccgagggtggtatggccaccgtgtatgaggccgtcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacgcccaaggcacattctccgtacgtgagacgctgcgcgtggtcgcggagacgctggatggtctggcttccgcgcatcgcgccggcgtggtccaccgtgacatcaagcccgagaacattttgatcaatgatcgcggccatgtgcagatcaccgatttcggtctggccaaggccgccagccaggccacattgagctccaccggcatgctattgggcaccgccgcttatctggctcccgaaatgatcgagaacaatcaggccaccgcgcaaggcgacctgtactcggtgggcatcatggcatgggagatgatgaccggcaaagtgccgttcgattcggataatccggtgacgcttgtcttcaagcatgttcatgaggacgtgccgtccgtggccacggtctgccagggcattgatccgtccgtggcggcgttcatcgcccatctgaccgcgcgtcaggtggatgcccgccccgccgatggcgcggcagcagctgaggaattgagccagttggccgccaaattgccgctggaggcgtggcaataccgtttgcatgccgaacccatcggaggtgatcataccgatgccaccgctgcagcgctggtaggcaatatcgccgagcaggccccgctgaccggcgtacctgccggtgcagcaacgttcgagccgtccgtaccggcatttttggccgatgatgccgcaagcaataccgccgataccggtggcgccgcagacgtcaatcccccggcgcctccggtcgcccccaccacggcacttgattcgtcgatgttagccgatgcttcggctccccataagacgcagatcatggcacagtccggcagcgagacacaagtgctgcctcaggccggcgatgccttcacccgagcgcttgccctttccgatgagccggacgtcgcttccaatggcaccgggccaaagaagcagcgcagcaaaaaaccgctcatcatcgtactggtgatcgtgctggtactggctgcaatcggcggaaccgccggctggtggtggtttgccggaccgggcagctattggagtgtgcccaagccggatgacgtgacctgcgatgcgaatgcaggcaccgaatgttcgctggccggcgcggattgggccacgtatgaaagcacgttgaaggctctcggcatcccctacaagacgcacaaggaatacagcgacgacgtggcggaaggcaagatcatctcttcttccgtgaacaagaccaaggccgttgtgaacagccacataagcaagcgagccaatcaggagcttacggtggtggtgtccaagggcgtgcggatgaccaccatcccgaaggatattctcgacgcggattcggccaatggcaaagacccgttgaacgcgctcaagaaggccggcttcgataatgtcaagcacgacgagtcgaaggacgagtattcgatggacacgccgcagggtgtggcgttgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggccaagtcatttccgcgtctcaggaagccggagcccagctgaagtggggcgatagcgtggacgtggtgatttccaagggtccggagatggcgacgataccgtccggccttgtcggcaaacaggaaagcgccgtgaccaagacgcttgagggtctcgggttcgaggtgaaaaccgacaaggtgctcggtggtctgttcggcacggtacgtaccgtgaaaagcggggatacggatctatccaacggcggcaagattcgcctgcgcgatgccaacggcaaccccaccgtcatcaccctcaccatcgtgtgagatttgaatgaggctccctctgtcttcagacgagggagcctcatttgttaattacttttcggcttcttcagcggcctgctgggccttgagctcggccttgaccttctgggcgtattcgttcacgaattcctgaccgctcattttctggattgcggtggaaacacgatcggtcagcgaacgcaaatcatcatgtgtaatttcatcagccggcttcttcgcaacctcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtctgggctgcgcgtgccttcaatgtggataccgaacaggtgcccatcctcgataatctcgcgtgcgtgcttgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcaatcaccgccagatggttggctgcgataatcgcgccaccctctcgaggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccggtacttcatccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggcccccgtgatttcaccggctccagctggctggataccgataatgtgatggacgcctatgatgatggcggcttcactcccccgaaccctgatcttggtccggtcaaagcatctacggtactgctgacggcgttgctcatcatcggtctcgcaggcgaaacggtgatgatattcgttcccggattgaacgcgattcctctcttaggcgcgctgctcaatattctcttcgggctgggcgtcattttgggcttgggtggattggtggccaaaattctcaaccgcaaagaccgccccggtgatcagggcggctattacgacgacggcgcgagggtgtagctcgcgtaggctgtgtggtccttggctcccctctctgaggctgagccgttaagcgaacagcccagcgggctgtttgtaggcgaggtgtgagagatagcgaaccaatgtatcacaggcgtggctcgtccgtaattgcggccgagccaagataggtcacgaattgaagtcgatggactcctgtaactcggcaatcatggccttgatgcgggcgtcgcctccccaccagttgagacggatcgtcacgtcccctttggccggcacaaccggcacatcagcggcaccaaccgaagtgccgcgcgtcgcagtcacgcacaaggccacggccgccataacagtcgccatatagacacataagcccccctcatcagaggaggctgagtacggtgtatcacgccttggacttggcggtttcgatccacttgtcgaacagggcttcggccttgccggaatcgacggtttcctcggccagcttgtaggcttcggcgaaacgctcggccagtgtgccgttgccgaccagattgccgtcggccacgatggctgaggcggcgttgagcagtgcggtggtgcgggacggaatgtccttgccggccaggaagtccttgaatgcgttggcgttgacgtccggaacgccgcccttgagctgttcgacggtaatcttggccaagcccagatccacagtcggatcgaactcggactcggtaaccttgccgtcgcgaatctcccagacggaaaccgggccggtgggggcaagttcgtccatgccctcgtgggaggtgtagaccaagccagactgtccacggctggcgtacacggctgccataatcgggctcaccttgcggttggcgcagccgatggccacgtgtgctaggttggcggggttggtcagcggccccaggatgttgaagacgcacgggatgcccagcgcggcgcgaatcggccccacgaaacgcatggccgggtggaaagtgcgggcgaacgcgaaggtgatgcccacctcgtcgcccacttcgccgacggcttccggcttcagatccagcggcaggccaagggcttcgagcacatcggcggcaccgcacttcgaagatgcagcgcggttgccgtgcttgacgatcttcacgccggctgcggcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacggcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtaagcgtgaggggcgttcccgcgtattctgttttccgaccaaagaaatgaatcacgaagaacgcctgggcaaaagcccattcaccggattgccgaacgtcaaaggcacggttgcagaggatgcgcggatcacggattcgccgccgcgttccgaacccgtgctcgagatccgggtgcgtccacgtgcgggtatgctccgatgctcccgatgcggaaggaggtgccgcgggcatgaccagggcggcggcgtgcggcgtcgtggtcgcttccgtgccgtgggccgagccgggcagccggtccacacgcgatttcgaatcggaacgcgcgtggccgatgagcgtcgcgaaccagaagaccgtaagcggttttccgcacgtcgcgtggcgcgccgccggaagacgccgcccatagggtcgctgaacggttgaaagcgtcgatgccgtctccgttcggcggcctcacgtcgatcggcgtggacgagaccagctaccgcaaaggccacacgtgcatcaccgtggtcgtcgaccacgaacggcatcgggcgatatgggcgcacgacgggtacggcagggacgtgttcggcctgttcttccaaacgttgacgcccgaacagcgcgcctccatcagggtcgtcgccggggacggggcccggtggatcgactcatgcgtgcatgagtggtgcccgaacgccgaacgcgcgcccgacgggttccacatcgtcagttggacgagcggcgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccatcccgcaacagtgtgggatacgacgtcaaaatccgcgaaaatcgcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcacgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacggcctgacgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacctcctcatgctcgtccttgacctgggccttgatctcgttcagggtgcccggccaacgcttctcgtactcttccggggtgtcttccggagagtagccttcggacttgagcttggcgtcggcaaggaactcgacgttgccgccgagcatgatgtcggtaccacggccggccatgttggtggccacggtgacggcgcccttgcggccggcgacggcgaccacggcggcttccttctcatgctgcttggcgttcaggacctgatgagggatcttggccacgtcgagcagagtggagaccacttcggagctttccacggaagcggtaccgagcagcaccggctgtcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcttcgatggcctgatgcaggccctcgttgtagcggcggcccggaaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtggccgcgttgcacgaggtcggccttctcccaggccatgttgtcacgcaggtagtcgaagccgaactcgttgttggtgccgtaggtgatgtcggcgttgtactgcttgcggcgctccggcggcttctgctcggtgatgatgcagccgacgttcatgccgaggaagcggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccagactcttgccgttttcgatttcctgcttgaacttcggggtttgggccttcaggtcctcgtcggagagggcggagatctcgtcctccagggcgttcacggccttggccacgttctccagcttcttgagctggtggccttcacccattcgcagggctttgtcaataatatcgaccactgggttctcccttgactgataagtggtggtgtccgcgtaccagaatagcgcctcgcaccgtcagcaatcgaatttttcgacctttttacgaaaaaatggaccgcttccatattggaagcggtccatgcggtatcagctgatcatgtcagcagcccttaccctcaggctttcttgacattctccggagtgtcgatttcgaacacgccgtagctccaaccgtgacggtgatagacgacggacgggcgtccggtctccttgttcacgaacaggaagaaatcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccggctcctccgactcgggctccggggcgataacacccagatccaccggaaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttgttcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacgtcatggcctcaccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcaaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgctgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccatcgagaaaaacgtcccgacggtttcgactgaacatgctgctcggcaatgggcatgtcttgcgacgcaacaggattgcgccgcaagaacgcttcggcactaatcatgttcaggccttagctgtgccggccttggcacgggtcgttttggcagcaggcgctgctgcggccttgctgtccttggccacgtcggccgcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaacgcgccggtcatcttgcgcagcgcctgactcatgagtcgggcctgcaaaccaacatggctgtctcccatttcgccttcgatttcggccttcggcactagggcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacaccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcagctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaagccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggagcgttatgatcgtggccccaacgcttggagtccggaacctccatttggtcgcagagcacattccagaccacgcgtggctcctcccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaacctcttcgcgcatgccatcaagatggagttcgacggctttgagcacttcggcatggtccgcggtgaggcttgcggggatgcgcaggcccacatacaccagtccggccggcttgtcaccgtccggaccggggccggccacaccggtggtggaaaggccgatgattcggtcgccgtattccggctggctgtataggcgagcggtaccgatggccatctgccgggcgacttcggggtgtacggcaccttctcgatccaatagggccttgtccacgtgcaggatcgaggccttggcattgatgtcgtaggtgacagcggagcccaacaacacgttggaggcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttatacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccataacgaagaaacgcataacggtgataccaatttcgcgaatcaggaacaggatggttacccaccagccgagctcgccgaacgcggagcatacaatcattgcgccgcaagtcagcagcttatccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaatcaccacgagtacgatgcgcgagtaggtgaccaggttcggcggcgcgttccatccgtcgaacagcgatgatttgggcgatgactgcttgtccattgtgttctcatccatagtgttcacgttacccccacacttctaccttgagtgagtattggctggatattgactgctattattcgggaatcaggttgcgtgctgatggccgcgtggccgcgcttctctccctccgccccttcggggcacctctctcatcagaggaaggtcgatggcgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgttgtctttcttttcggcttccttggccatctgttcgatgtcttcgcggtacttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggacgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggctaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcaccggccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggacttgccgggaatcggtgaaaggatacgcacatccgaactggccaccgcgtaggcgatgttgcgctgcaggttggtgactttctccaccttgacgccggggccaagctcgacctcatattgggtaaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccatccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcacagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgtcgtcgttgccgtcatcgtcgccgtcatgcgagggaacaccgtcggcaaaggcgagagtggtatctcccacacggacctcgttggggaactggctggcgctcccatccgtctcctggcccatcggcacatacggtttgcgctggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcgatggcgtgaagcagctggccgaatggaccgctgacgcggaaccattcggacgcgcagaacagtacggcgagcacgagcagcaggaagcacaaaccgtcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacatccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagactgccatgcgtctgcgcgccgccgccgaccctgccggaaaggaccgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaggagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgcggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccggatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgctggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggagccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacacattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacctggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttccccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtatcccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcaggaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcgccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgccggcgaacaggatcaggccgatggcgcagacgatcttggtcatgccgtcgacctgcacgaaggcgagcacgatctgcgagatgatgagcacaatcaggccgatcatcaggatcgggccggccttgagcatgttgaacttggtagtcatgccgaacatggtcagcgcaaagaagaacgcggcggtgacaccgagtgccacgccgatcgagccgaggtcgtagaccatgaagatcgagctcaaggtgaagcccatcaatgcggcgtacacatagaacatgacgcgcgcggtggccgacttcatcttggtgacgcgcatgccgagcaccacggccagggcaatctgcaccacgcacaggccgatgaggcccaccatgccggtggccatgaggaagctgtagtaggctccagtgatctggccgagcacggcgaccacggcggtgacgaggatgccgatggtcatctcgccgtacaccttggttacggagacgcggcgggcctcctcgtagttgtaggtcatcgtcgtgttgatggtggcggcacccgcgccggcaccggccgcatcctgcggcgcgtactggtaggtgggagcgccctgcggctgggcatagtagttctggccgtaaccggactgtgcgtattgctggccatatccagactgttgggcggcgttgtaatcaggcgtgttgtattgcgggttgtattgcccgttgttctggggctgctgaccgaatgtcataatcgctcctttagcgtttgttccagtaccaatcttagaggaacaaagctgaacattccatgaatatgatcgatcggctcgttctgctcatctcaaagcgtaacgggcgtttccaccatgcgcgtggcatgcacttgagattcgattgacattcgatcgcagcttggaccgccgcgcgattcactgcaacgtgaaggtatgcgtcaccttggtgtcttgatccgttgataggaacgcagtgacatccaccgtaatcggcgaatcgtcttgcagcacatagcccagcgtcaccgttgccgcggtcccgggctgtgcttgggccaaatacgaattcgcgtcatagccttcaggctgatcgaagtatactgccgtctccagttcggtgccgttctggaacacgttcgggtgagccaaagtggcgaacgagttgttcttggacgtgttgttcgtccattcataagtcaccagagcggtgggcttgccgttatagtcgttgacgcttttcacggcggagactattttcacgtgggcaccttcgatatcaccttccaaatcctgctcgccctgcgctttctgctcggatgccttgcttttggaggcatcagacgatttgcccgcggactttgatgatgaggattgtgacgtgtcgatgcccttggactccttaatggaatcgtcaatggccttgctggcagcggactgcatggccagcgtgatcacaatggccaacaccgacagcaccgccgccacaatggacagcaccttgccgcgtttcttgccccggaaggtgcccactatggcgataatcgccagtatgacgccgatgaagccaaggattgcggcgatattgttgacgatgggaataaaactcagcaccaaacccaacgcgccaaacaccacggccgcgatgccgcagatggtggtatgcagatgttgcggttgcggcggctgaggctgaggctgttgtggctggtactgctgtggggatgagggaaccggctgcggggcgatgttgtggttggacatgatgtgctccttctcgtatcttccccgaaatagggatgtgagcacgacgctaccggccgcgaaacagcgacgttagtggacgaacggtcattgttcgttgcctgttcgggcaatacggaggtgataacggtgcccgcatgtccagtggcgggggccggatgcaggtcatacagtggaaagcatgacgaacccacaacgcgccgccgggccataccccggtttccgacccggctcacggcctgacgctcgccctatgcccggcacggggtccccggttcctacaccggatacggacgaggtgcccgtgactacgcgcgtatggtgttcggtcgttatggtgccattggccagtttcatgtgcatggcgcaaacctcgttcttcgcccagaattttgcgcaggattccgcaggatacacgctgatggtcctctgcaccttgctggcattcccggcagggttcctgctcttggcccgcagcgaatacccggaggcgacgttctggatcgcctgcgcgctggtggtcgtgttcccgtatgactcgctcatcgcactgatggcgatgacctcattgctcgcccgtcgttcaaaccggaacacgaccatccgcgccacggttggcggcaccatcgtgacgctcatctcccagctccgcgacgccctgcaacagcccaaagcctcgatttggcatctgattttcgctcaaccgcataccggcggcgatccaggctccccgatggtgatgctggtggaggagccgaccgtcatcatcaccgccacggtggcctcactggtgttcgtgaccatcgctacgctcatcggcctgcatatccgttcgcgcgcccgcctgcgcacggcgaatgcggtggccagcgcggccaccacgcatgccgcgaccctgcagaccgacctgaccaaccagcagctcgccgacgccatcgcagccgaagcgcacgacaccctcgcgcattccctgtccttgatggccctgaacgccagcgcgctcaaggcggaggcggccaagctcggcgactcccccgaagcgcaatcgttggcggataaggccgaggacatccgtcggcagtcggccggggcattggacgaggcccactcgatcatcgacatgctgcgcaacccgcaccaggcatgggagcagctcgccccgtccgacgacacgtcgctgacccgcgaatcgctggatgcgctgattgcggacacgcgcaactcgggcacgtcgctcaacacctggatcgatatccagcagctgagcgtgatggatgagtcaatcggcaaggtggcctaccgcgcgatccaggagggattgacgaacgcgcggcggcacgcgcccggagcgccggtgtcgttggaggtctccgccacgccgcaggcgggcgtacatatccatatcagcaatccgatcgccacggatgcgaccgagacgcagcgggcccatggggccggactgcctggtttggcagcgcgcgtgcactcggtcaacgggcaatgccggtatgggatggacgatcggcacctgttccatgtcgacgtgcaactgccttggcgcagctaagatggctagcgtgagtgagaagaacgggaatagtgtgtctggtggaaagcccgaacgcggcggtctgaccggaagcggcaccggcttagagcccaagccgatccgggtcagcgtcatcgatgacgatccgatgatctgccaggcgatgagcctgatcctcaacgattattcccacgggcgcatcgaagtcgtctccacgtccaccgatggcgagacctgcgtgaggcgggctgccgaggaaaagccggatgtggtgctgatggacatcgccatgcccggcgtggacggcatcgaggcgacccgtctgctgcgctcgctctcccccgcgccgcacgtgctgatcctgacctcgttgagtccgtccggcaccgtggaacgcgcggtggaggcgggcgccgaggggttcgtgtcgaaaaccgatgcggcggacgatatcatccgccgcatcatcggggtatgcgagggcgcgccgcagttcaacacggccagtcagaaacagctaatcgacgatctgagcgtcacgcggccgcgttcgcgccgcgatgaggcgcgcgccctgctcgacgcgctgcccgaccgcgagcgcgaggccgtgatgctggcggccgagggctatacgaacgccgaaatcgcctcccgcatgttcatttcggagcgtacggcgaaggcgcatctttcttccgcggcgaacaagctcgacatgggccgcgtgcagatggcgcggctggtggagcgggccgatctgccggcgcggctgtaagtcgtccggttgttgagccgtatcagtcataatgggaatatgagtgaagcgattattcgaacattacgtagggatgactatccggcgctgatcgacctggtgcgccgcacctggtatgccgaattcgatgagcggaccggtctgctggcggccgaagcggactgggagaactgtctggcgcgcaccaccaacgcgttcgtcgccgaactggacggccagccggtcgccctgatcgtggggcgcgtcgatgcgctggaccatcggagcccgctcaactcgcatcggatcaactcgtggaacgcgctggcgcggctcgtgttcgcgaagggcggaatcaaggccgccggcgagattctgggcattctcggcatcgacaaacggctgcgcgcccaggccgcgagcgccgggcatgactatgcggcggaagtggtgctgttcgtacttgacccggcggcgcgcggccacgggctgggccggcgcatgttcgagacgctgatggacgcgttccgcctggccggcgtgcgcgactacttcctgttcacggacaccacatgcgatgtcgggttctatgtgcatcgcggcctgacgcaggtgtgcgagcagtcactgcccgcatccgtgccgggagaaaacccgtcttcgttctacttgtatgaggggtcggtgcccgagccggcgtgatgtgcccgccgtcgggcaaacactggtaggcttgagcacaagttggtatgccggcataccgtccacaggccggcgacgaaggggctgacatggcaatcagtgcgaaggaactaccactcgggaaagtgttcaccccggatttccggttcacgatcccctcattccagcgggcctacatctggaagaccgagaacatcctgcaactggtaagcgacttggatgacgcctgcaagtcgcccggtactccgtacttcctcggctcgctaattctggtgcgcgagggcgataaccgttacgacgtaatcgacgggcagcagcggctggtatccctgtcgatcatcatcgccgtgttgcgcgatctggagcgagacccggacctcatgcgccaactcgacgcgctgctggtggagcccggcgacaagctgcgcggcatcgtcaccgagcctcgcctcacgttgcgcgagcgcgacgcggcgttcttccgcgaacacgtgcaggaggacaacctcgaatccgtgttcgacatgaacgacgacgatctggcgaccgctgcgcaacgcaatatcgtcgccaacatccgcaagacgtacgacgagatctccaattggtcggcatccgaacgccagcaattcgcgcagtatctggtcaacgaggtgacgctcgtcatcgtgaccaccgacgatctcgacggcgcgcatcgcatcttcgacgtgatgaacatgcgcggcctgccgctcaccccgtcagacgtgttcaaggcgcgcgccacggccagcctgtcgaccgccgaacttgacgtgtacgccgcccgctgggatgacatcattgacccgcttggcgacgatccgcatgactgtgaggaattcttcgcctatctgcatctcgtgctcacgcacaagccggccaccgacaagctcatcgaggatttcctggccgacgtgctgcaaccgtacatcgacaaaggcacggtgcccacgttcatcaaccaggtgctggcaccctacgcgatggcgtggcggattatcgcgcgccccagcgataccgtactgcccgccgaggtgcgtagccggcttgagggattggacgattaccgcagccacgagtggaagcccgtggccatgtgggcgttggtcaattcgtatcgcgggctgggcgacgccgatttgtcgccgttcgtggttcgtgcctcgcgtatcgccagaaccacggccacgttggaatcgttgggcgcccatgacgagcgtcggctgctggaaattctgaccgcattggaacaggtgaccggcatccgcacgctgaatcgcgctggaacgttggagcggcgcggttatgcgaacgccgccatccgtgatcttgacaagggctatttggtccagcgcgtgaacgggttgcatgtctcggacggcgaccgtgaaggcgcattggtccgtttgcatggcgagatgcagggtgacggcgatttggtccgtctgctgctgattcgcgccaacgagcagaaggccggcatgcagttggatcgaccacgccggttcagtgcgctgccgattatgccgttggatatcgaacggtcgaaatcgtttgcggactggccgcaggatcagcatgatttctggatgtaccgactcggcaatatggcgctggtgcagggccctgaggatcagttggacaggttgagtgaatatccggcacgtcgcgaccgcatgctgttgcgcgcggattcacgtcgtttcccgctgaccaatcagttgaaggatttcgctgactgcacacctgccctgctggaggcgcggcaggaagagtcggtccgactcatcgtggaatactggggcatccggtatgacaaggacgcccgtgatctgaccaagcagaatgtcgatgagttgtcgaagacttctccacggccgtctcatagttcgcggcgcgtcacgatccggcaggtgattgacgctggtctgctggtgccgggcgagcgtctggtgtgggatcggccgcgcaagggcgagcgctggtttgccacggtcaccgaaaacggtcgtctccgtctggatgacggctccgaatatccgactccgaccgccgcggcccgtgccgccgccggaggacgtcgcggcggcggtctggacgtgtggaagcgcacgcgcaacggtcagaagctcagcgacatctggaagcagttccgtctacaggcgcagtaggctacggcggccggcacatcattggtggctcccctccgtgagggaagccaaccgctcatttattccagtgccgccacgatttcagccggtgttttgcaatattcgggaaaatgactgattagttcggcatccgatgtgaccacacagttggcaccggattgttgcgcggcaacgatgatcagatcatcttcaaaatcccgatgccgtttttgcagggaaaaagccttatcacatgtcgactcatcgacagcgacgatgtcacacatctccttcacctgctcgatacaacgccatggcacccgcgacgacagaaagccgcgagtgaaattctccacttccgattcattcggtttgaattccctacgaatcgccgatgatgataggtatgcgatatccttcagcgacaatgacgcgcacaacaacgtaatgttgttcttcgcgccaagttccataaccgcttccgccatcttggcgtgatcatcgcgatggagcaaatagtccaacagtacgttggtatcgagcaaaatacgctgcatgaaaacgtcggtcatcaatcggccctcttcatgttgtaatacgcatcaagttgctcgtcgtacattttgtcgcggaactgcttgtaggtaaggccttccatgaggtcggtgtcttctgagatcagtccggccttgaccagttccttgtgtacgtatccggcaccttctcgaatcagtttcagcttgcgctgcttttcctcctcgcgggcttgctcttcggcggtcgtttccaatgccggcacttccttgcggtcggcgatgtacaaccacagcgaccggattacgtcactcaccgatacgcctttgcccttgaggacttcttcgacctcgttcttcagtttcgcatcaatgcgaacgttcatttggaccatggtcatggcaacctccatttcgaagatgctatacagtatagcattttggcatgcgtggaaaaggccggtatccgttggcggataccggccttgctctcctcagtcagcttcgctgacagctcccctcaagagaggggagccaagaaggtggttacttcatgaggttgcgcagcacgtactggaggatgccgccgttacggtagtagtcggcctcaccgggcgtgtcgatgcggaccaccgcgtcgaactcggtcttggagccgtcctcgtgggtggcggtgacgtggaccgtcttgggggtcacgccctcgttaagcttctcgacgccggcgatatcgtaggtctcggtgccgttgaggcccagggactcataggattcgcctgccgggaactgcagcggcagcacgcccatgccgatcaggttggagcggtggatgcgctcgaagctttcggtgatcacggccttgacgccgagcatcaccgtgcccttggcggcccagtcgcgcgaggagccggtgccgtattccttgccggcgagcaccacgagcggcaccttgttgtcgatgtagtcgcgggaggcttcgaagatcgtggtcggcttcttggcgaggaagtcgtaggtgaagccgccaggcgtcacctcctcgcccacggaggcgagcagctggttgcgcagacggatgttgccgaacgtgccgcgcaccatgatctcgtggttgcctcggcgagaaccgtaagagttgaagttcttcggctccacgccgcgctcggtcagatacttgccggccgggctggaggccttgaacgcgcctgccggggagatgtggtcggtggtgaccgagtcgcccaggagggccagcacacgggcgccgtggatatcggcgaccgggtccggcgtggccttcatgccgtcgaagaaggtttgcttgcgcacataggtggacttgtcgttccacgcgaacagctcgccttccggcacgtcgaggcccttccagcggtggtcgccgtcgaacacggaggcgtagtccttgaggaacatctcgcggctcacgctgccgtcgaccacggcggcgacctcggcattggtgggccagatgtccttcaagtacacgtcgttgccgtccgcgtcggtgccgagcggttgggtttcgaagtcgaagtccatcgtgccggcgagcgcgtaggcgatgaccagcggcggggaggccagatagttcatcttgacgtccgggctgatgcggccttcgaagttgcggttgccggagagcacggcggtgacggtcaggtcgttggcgttgatcgcctcggagatctcgggcagcagcgggccggagttgccgatgcaggtggcgcagccgaagccgacgagctggtagccgagcgcgtcgaggtcgtcctgcagaccggcggccttcagatagtcggccacgacctgcgagccgggggccagcgaggtcttgacccaaggcttgggcttaaggcccttggcatgtgcgttgcgggcgatcaggccggcggcgatcatcacggacgggttggaggtgttggtgcatgaggtgatcgaggcgatggccacgtcgccgttttcgatgtcgaaatcgccgcggaagtcggtggacacggccaccggatccttgacggtcttctcggtctcataggcgggagcggtcttctcgaacatctccttggcttcggagagcagaatgcggtcctgcgggcgcttcgggccagcgatggacggcaccacggtaccgaggtcgagttcctcgtattcggagtactgcggttccacgtaatccgggtcggaggcgtcgccccacagcttgttggccttggcgtaggcttcgaccaacgcgacctgttcttcggagcggccggtcaggcgcaggtagtcgagcgtgacgttgtcaatcgggaagatgccgcaggtggagccgaactcggggcccatgttgccgatggtggcgcggttggccagcggcacggaggcgatgccttcgccgtagaattccacgaacttgccgaccacgccgtgcttgcggagcatgtcggtgatggtcaggaccacatcggtggcggtaacgccctccgggatggagccggtgagcttgaagccgaccacgcgcggcacgagcatggagatcggctggccgagcatggcggcctcggcctcgatgccgccgacgccccagccgagcacgcccagaccgttttcggtggtggtgtgcgagtcggtgcccacgcaggagtcgaggtaggcgagcgtgttgccgttggcctcggccttgctcatgaccaccttggccaagtattcgatgttgacctggtggataatgccggttcccggcggcaccacgcggaagttcttgaatgcctgctgaccccagcgcaggaactggtagcgttcaccgttgcgctggtattcgatgtccatgttctgctggaccgcgtcggcgatgccgtacttgtcgatctgcacagagtggtcgatgaccatatcggactggacctgcgggttgatgacctccgggtcgccgccaaggtccttgaccgcgtcacgcatggtggcgaggtccacgatgcagggcacgccggtgaagtcctgcatgatcacgcgggacggcgtgaactggatctcgtggctgggttcggcgttcggatcccagtcgagcagggtcttgacgtgttcgtcggtgatgttggcaccgtcgatgttgcgtaccagattctcgaccagtaccttcagcgagtacggcagatgatcgatgccgtcaagattggcgatgttgtagtaatcgaagtccttgccggctgccttgagggtagccagctggtcgtcgcgtaaggacatgcttcctccgaaatcatgaatcggcttatgatgccgttgattatccgatacaaatggtacgggtacgttactttggctctggcgtgtcggcttgaagtgtgagacaattcgccgctattagatattgaaaccgtgctggcgcagtagattgccgaatattctgccgaccagcggagccagccatagacagatcacgaaaatcatggccgcgccgcccaacgcaatcagcgtggccaccaacgcagtgccggtaggcagaatcagcgcgaagaagttcgccacgaacgggatgaacgcgccgatgatgccggccgccgcgaaccccgcgaccagcgcacctcgccagctgttgagcggcctcgccacacgggccagcacaaacacgcccatcaaaaacagaataatggcgctggtggcgcgcaaagccgacagatcggcgtcattgttcaccacatcccagcccatgacgttcggcagggtccatgaagccagcaacaccgacagcgcggtggcgatgccgcccggcagcgcgaacgtgaccacgcgcttgaggaatcccggaatatagcggcgcgtgttcggcgcgagcgccagaatgaacgcgggcatgccgatggtgagagcgccgatatacgtgatatggcgcggcaggtatgggtatgggatttgcgtcagcactacgccgagcgagatcagcgcggagtacacggttttgacgaggaacaggctggccacgcgctccatattggccatgacctgacggcctcgcgccacgacgtccggcaggtgcgagaacttcgaatccaccagcaccacctgggccacggccttggtggcgggtgccgcattgcccatggcgatgccaaggtccgcctccttgatggcgagcgcgtcgttgacgccgtcgccggtcatggccaccacgtggttctgcgtgtgcagcgcttgcactatggccttcttctggtcgggcagcacgcggccgagcacatcgacgttttcgagcacgcaggcaagttcgttcacgtcctcaggcagttcgcgcgcgtccatcgccaccggctcatggtcgccggtgagtttcactctgcgggcgatggcacccacggtcactggattgtcgccggaaatcacacgacagcgcacaccctgctcacggaaccaagcgagcgtccgctcggcgtcctcgcgaatcttctcagagcacaacaccaacgccatcggctcagccttggggtcgagctgcgggtcgtcagatacattggctccctcaactgctcccctcagtcgcttttggcgacagctcccctcggagagggaagccagctcgctcttctcggctcccctctccgaggggagctgtccgcgaagcggactgaggggcgctgtagaccgcgcaaccagcaacacacggttgccgtcattggcatactcgttaacctgctgcaacaccgacgaatagtcaccctcaagcgcagaaataatcacctccggcgctcccatgtaccaggtctcgccggatttacgcaccgcactccatttgcgcgccgaagagaacgggacacgagactcaaccgcacctgccccatatccttgggccttgagcccggcgagtacggcttggccggtgccgttgggctgctcttcgttgcagcagtcgtagagggcctgcgtggctgcctgttccgcagccgcattggcggaatcgagcatcacgagccggttgaaggcgataccgccatcggtgatcgtgccggttttatcgaggttcagcgcgtccacgcgagccagtgtctccacggattcaagctcctgcaccagcgtattgtgacgggcgagacgcatggcggccaccgcgaagttcagcgaagtcagcagcaccaagccttcgggaatcatgcctactacgccggcgaccgcggaaaccacggcttgccgccattcgccggtggagagtgccgtgccccaaccgccgaccgtatgaatctgcgaaagaatcagcagaatgcacagcggtaccacgaggaaggtcatgaatttcagaatcgtgttgatgcccttgttcaggtcggacacggttttcttgtataccttggcctgcgcggtgagcgtggcggcgtaggaatggctgccgaccgcattgaccttgaccaatgccatgccggagaccgcggtggcaccggaatacacctgctcccccaccttgtggcgcacggtacgagattcgccggtgagcatggattcgtcgagttccagtccccaggtctggatgatctgcccgtcggccggcacctgttcgccggcgcggatccacagcaggtcgtcgagcacgatctcgttgtggggcacctccacgtccctgccgtcacgatgcacgaggaagtcggaggccacgaggatggatagcctgtccagcgtgcgcttggccctgagttcggtgacgatgccgatgcccgtgttgatgatgatgacgaaaccgaacaccgcgtccctccaggaaccggtgatcagcaccagtaccatcgcggcgaagatgatgccgttgaacagcgtgaacacgttggctcgcacgatatcttgaaccgaacgcgagctggaggttttcaccgcattcgattggccactttcgatacgctgcaccacttctttgggggtaagaccggtcgctccgatctcaggcatttccacggctgttgttgcactcatattccctagcctaccgcgtcttgtttcgcaatccactaaggctcagggatgattcagggtgctttctcagcttcaaggggctgattcggctcaggagacggtgactttgatctcgcgttcgtggggttcgtcgcgcgtgatggtgagcacggcgtcagtaatagtcattggcttggtatcggcagtgtcgccagaatcggcactgttggtgttgaggtgaaggatgacggcgtacagcagttcatcttcgggcgcatgctttggatcaatgagagcgactggaataccggcttcacgcgcattggtcaacgtctggttccagctctcccggttggcgtcggtaacgtcgatgccgctgataaccacgattttgaccgcgcgagctacgaaatcggcaacaccctgctgtgcggtggccgcattcttgtcgacgccagtatgagcatccatactatcggcaccgttttcgctggtagtgccggcgtcagaagattcggtttcaccggatacaccatcagttgcgtttgccgagcttgcggatgtttcgagcgaggcatagtagacattgagtttgtcatcagacagcgcattgatgacgaactcgtctgcggcggtgtcagtcgaccccacaaagccgactgtgacatccgtgggatgtgtggaatcgtgggcgacttccggcatgctgtcttgggtatcgccgaccgccctaccggccggcgtgcaggcggccagggacaacacagccgccatgcaggccagcaatccgagaattcgtcgtgtcatatgctcacctgtcagcgggtaaacagggccaccgtctcaacatggtgggtcatcgggtagatatcgaaggcacggatgtctttgagctcgtagccttcgccgatgagtgtcgcggtgtcgcgtgcgaggctggtgggatcacaggcgatgtagaccacgctggatgcgccggccgcggcaatctggcggcagaccttggcacgagcaccggcacgcggcggatcaagcactacgacattcggcttggccagatgcgccggcacatggtccagcgtgcgcgagacatcacccgcgcgggcgtccacgtcgttcaggttcatggcacgcaggttgcgctgggcgttcttgacggccacacgcgcgccttcaacgctgagcatgcgggtgcgttcaccggtcattgtggccagcggcagggtgaacaggccggaaccggaatacaaatcccagattacggcgtccgccgctgactgcagctgcccgttgaccagattgatcacgtgcgtaccaagggcaatcggcgcttggcgatgcacttgccagaacccgttggcgtcaacctgatagtcgaaggtcgtgccgttgatggtcacctgttcggtgagcagctgggagccggcgcgcagttcgccgtccacaagtacggcgtaattgtcgtctgctgccgcggtatcgacgatctcgccgcgcggttcgggcacggaaagacgaatctgggagccgggttcaaagccgccttcccacacgtgttcgcgcttggcgacgtccagcagcgtacgcgtggcaagcggcatggtgtcgatggccacgcggttgtgtgtgccgcgccggcgcatggatggcatgccgttgtcgtcggcaatcatttcgatgcgggtacgccaattgaggccgccggcttccttgtcgccgggcatgcgctcgatgggaacggccacgtcgatatggccgagtcggctcatctgttcggagacggtgatggccttccacttgagctggccgggcaaagagacgtgcacgagatccgcgccgcccactcccccgcccatcgccaagggaccggcaagtggccatgccggggtggctcggtcttcggacggctcgagaacctcgacgacttcgccggtccagaaccggtcgtcccggtcgtggggctcgtcaagttcgactcgcacgagttcgtcgggcaaggcgaagcggacgaacaccacacgaccgtcgatatgggccacacagcggccttggtcggcgtatcgttcgatacgaacttcagcttgcatcatcgtcctttccggttgcgctcggttcgagttcggcatcaacagcgacttcagtctgtatcttcctagccgcgaccttatgccggtgcatcggcgtggcaataatgaggtaactcacccaaatcgccaatgcccagaacggaatgcccatgagcaggcgggtcacgccgagtgcagccacatggttggtcagatacagcggcacctgcaccaccagccgcagcaggaacagaccgacccaaaggccggtgacaatcatataggcgcgtttcagggccttgtcgtccatccagtcatggaaccatgccttgaaatgctcggtgggcaggctacggatgaattcgacgaccaaacccagtccgggcacgcgcgcgatcagtgacacggcaagcaacgcggcatagccagcattggtaatgaatccgaagatgtagtaattgcgggcctcatgagtctgccatgcccaaatcaggcagatgcctaccgccaccagaccagagaccgcgcccattaccgactggcgctgaatcagtcgcacaataacctgcaataccgccaacacggccgaaaccgcaatggtgagattcagattgctcgtggccacgaacagtacgacgaacaccacgccaggcagcatggattcgatgacgccacgcgggccaccgatggcgtcgatgacggagaaatcctcgccttcattgccggcgtcggccagcgcggacaggccggtgcgtttgttgtctgccaagtctcttcctatagatcagcgaacttcggagaacatcgggccacgggccaaggtggtcttcacctcggtggtctgatcctggctcaacgggcccttcggcttgttgtccggaatgtccttgaagtgttccttgccgttcgcctcgccggcttcggccgcggccttggcggccttacgctcagcgggggcgaccggcggatgcatcgggatcagatcgcgcggcgccaaaggctcctcgccacgctcgacgacgatgccggcgaagaacttgttcagcgcctcggtctccgggctgtccggatcgatagcagccttgccggagaagatgccacgcagcatccagcgcgggccgtccacaccaacgatgcgcgtgttcacggtcttgccgcccttgacattgaccggcagcttcagttcggtgccgaacacaccgtccacttcagaagcggccttgttggcttcaagcaggtcaccgcgaacgtcatcccacagtcccagggtcttgggtgcggcaaaggcttcgatctccaggctggaggagccgaaggtgatggtggaaccaagcacttgctgggtggcgcggttggccttgatgcgcagttggatgccccggaggaagggcaggtagtaggcgcccagatccagataatcgtcataatcgggcacgtcctcatcattgacgtcccacgggcctcgctcttctccgcggccctggtattcgctggccggttcggcgagcacggtctccgcgctttccgcctttgctgcggcgtttgcggcctcggcggccaccttgtcctcatcgacaggctcaacggccggctcggcttccttcttgctcttcttcttgccgaatccgaacagtcccataattcctcgtttcatgtaacggttgcaaccttgctaacactagcactcaggcttagagaaagctgagtcacacgtcgtatgtgatggtaagtggcgcgtggtcggaccaacgcaactcgtatgtgggggccttgtcgatcacaaagccgcgcgcggtctccgccagctcgggcgtggcgaactggtagtcgatgcgccagccgacattgttgtcgaaagcgcgcccgcgctggctccaccacgtgtacggaccctgaatatcaccggcgagcgaacgcatcacatccacaaactcatattcatccagccacttgtccacgtaggcgcgctcctcgggcaggaagccggcgtgcttttcgttggccttggcgttcttgatgtcgagcggcgtgtgcgcgatgttgaaatcgccgcacaataccgcctgcttgccgccgtgcgcggcctcgtcgcacaactcgcccatgcgagtgagcatcgtgtccagaaaacggtacttctgttccatcttggtcgaatcatcggtgttgccggcgtgcacgtacacgcaggccacggtgatcgtgtatccctgcggcgtcttgacatcggtctcaatccaacggccggaatccacatcctcgctcaagcccggaagtccatagcgtttatcggtcacctcaagatcggtgaggagcccgactccggcacgacccttgacacggcagacctcgttcagcgaatgcaggtcagagggtgaggcgatcttgccggcggtggcatactcgaaaccgaattcgccgaaaatcgaatcgacatcctcttgcggggcgcgcacttcctgcatacaccagacatccggagcatgtttgccggcccagtcctcgatgcccttgcgctttgccgcgcgaatgccgttgacgttcgatgtggtgatggtgatggtcatgcagccatactattttggcctctctaccagtaccgcactcacgattacattgaggtataaaaaattagctccctcataagagggagctaatttagaatgtcctatcagtccaaaccgagctggagcttgccgccggggatggcgtcgagcaggtctcgggtgtactgcttctgcgggtggtcgaagacctcgtcggtggtggcatgctccacgagcttgccgtgctgcatcaccacaacctcgtcggcgatctgacgaaccacggccagatcgtgggtgatgaacaggtagctcaggcccttttcggcctgcagatcgttgagcaggcgcaacacctggtcctgcaccagcacgtccaaagcggacacggcctcatcgcacacgatgacgtccgggtccagagccatggctcgtgcgatggcgatgcgctggcgctggccaccagagagctcgttcgggtaacggcccatcacggaagccggcatctcgaccatgtccagcagttccttgacacggttggcacgccacttcttgtcgccgatcttgtggatgcgcagcggctcctcaatggaacggaagatggagtacatcgggtcgagcgaaccgtaggggttctggaacaccggctgcacgtggcggcggaagcccagaaggtccttggacttgaacgtggaggtgtcgcgaccttcatagaacactttgccggaggtgggcttcaggaggtgaagcaccatgttcgccacggtggacttgccggaaccggattcgcccacaatggccagtgtggtgccacgcttgacggagaaggacacgtcatcgacggccttgaacatctccttcttgcgcggcagcttgaattccttggtcaggtggtcgacggtgatgatgtgctcgctcttttcgagcgtgctttcgccggcgatgtggtgatcgagcagagcgtccgcatcctcaccacgctccttggcggagatgatgcgctgggaggccagcgacggggcagcggccaccagtcgcttggtgtacgggtgctgcgggtgctggagcacttcaagggatgggccggattcgacgacctgacccttgtacatcacgacaatgtgctgggcgcgctcagcggcaaggcccagatcgtgggtgatgaacagcacggcggtgcccaacgagtcggtgagcatgtgcaggtggtcgaggatgcgcttctgcacggtcacgtcgagggcggaggtcggctcgtcggcgatcagcagatcggggcggcaggccaagccgatggcgatgagcgcgcgctggcgcataccaccggagaactcgtgcgggaactgacgggcacgggtagcggcgtcgggcagaccggcctcggacagcagacccgcgatacggtcatccattgtggagccggtgacgtacttcttagccagataccaggcctggtcgtcggccacgccggccttgatgaggtcgtcggccacgcgccaacgggtttcggagcccggaacccattcgttggtgaagcgggcgacggccttgtcgaaggcctcgccggacacgccggcttcagtcaaagccttcttggcctcggtcatgagctcgggcagttccttggctccgaggaaggtctcgtcgtcgttgcccttgacttcgacctcgtcgccggccagagccttggcaagggcggagcgcttttcgtgagccacgtccatgttgttggccttcagtgcttccttgacctgggtgccgatacgccacaccgggttgaggttgctcatcgggtcctgaggcacgagacccatcttggtgccgcgcagcttgtcgaactcgctctgcttggcgccggcgatttcctcgccgtcgagcttgatggagccgttgaccacgtgaccggtgccgggcagcagacccagcacggccatggcggaggtggacttgccggaaccggactcgcccacgatggccacccactggccagggtagacggtgaagttggcatcgcgcaccgcgtgcaccggcttgccggtgtcagtggtgaagtcgatggccagatccttgacctcgagcagcggaccatgctctttctgcatagccagcatcttggcgttggtgttgtcagtcataatgtttctccactcccctcgctcaggccgtacggctcttcggatcgagggcgtccttgacggcgtcgcccatcatgatgaacgcaagcacggtgatggccagtgcggcggacgggtagaacagcaccagcggatcagtctgcaggttggtctgtgcgctggagatatcgccaccccagctcaccgtggtggtcggcaggccgacgccaaggaagcttagggttgcttcggccacgatgtaggaggccagcgaagtggtggcgatgacgatgatcggggccagggagttcggcaggatgtgacggaacaggtttctggcaggcgtggagccgagggccgtggaagcggtgttgaattcgaggttcttcgattccagcacggcgcttcgggcgatacggcatacgccgacccagccgaagagcgtcagcaccagcacgatcttccagatggacttggaggtcttgaacatctgaagcaccacgatggcgccaagcagcataggcagcgcgaagaagatgtcggtgatacggctcagcaccgcgtcgacccaaccgccgaagaagccggcgacggcaccgatcagggtaccgacgatcacgaccagcagcgtggagagcacgccgacggacagtgaggtacgggtgccgtagaccacgcgggtgtacacgtcgcagccctgcaggtcgtagccgaaggggtgtccggcggaggcggggctcaaggagttgcccagatcgcaggcgttcggatcctgcttggtgaacagaccgggggcgatggccaccacgatgatgaacaggatcagcaagccggagatgatgaacaacgggttgcggcgcagggttcgccatgcgtcggcccacatgctggtggccggtgcggattcgtcgacggaatcgacgtcctgcaacggggtctcgtcgagaggagctacgtaacggtcctgaccgggcagggtttccatgaagtattcggttcctggctcgccggtctggttgagctcgttttcagtggtttcgtttgccatgtgactcactcctccctatcacgcgtaacggatacgcggatcgagggccgcgtacagcatgtcgacaacgaggttgcacactacgaaaatcagcatgagcaacgtgacgatggacaccaccaggtttgcctcgcccttcagaatggactggtaggtgaggaagccgatgccgtggatgttgaagatctgctcggtgatcatggcaccacccatcagggcaccgatgtcctggccgaggtaggtgacgactggaatcagggagttacgcagcacgtggcgcagcatgacctgaccgttcgacatgcccttggcgcgtgcggtgcgcacgtaatcctcggcgatgttggaggagatttcggagcgggtcagtcggatgatataggccatcgacaccgaaccgagcaccatggccggcatgagcagatcaaggaagccggggtcggcgcctgccgtcaccggcaatatcgcccactgaataccaaagacatattgcatgacgaagccggtgacgaaggtcggcacggaaataagcagcagagagacgatcaggataacggtgtcgtaccacttgcccttcttgaggcccgagataatgccgaagacgacaccgaaaatcgcctcgaacacgaacgccatcaagccgagcctgatggtgaccgggaaggcgcgggtgatttcgtcgagaacgggctggccggcgaaggtatcgccgaagttcagggtcagtgcattcttcaggtagatgaagtactgaacgatgaacggctggtcgagatggtattctgcgcggatctgggctgcgacggcctcattgacgggcttgtctccgaacatggccttgactgggtcgcccggcagggcgaatacaagggcatataccagaagagtcgtaccgagaaccacgggaatcatctgcagaatgcgtcgcagaagatacttacccatacggttgctccttatttcctagaccggccagaaagggtatagtacgcccccgccggtcgataaatactccgacagtttaccgcatgcccggactgtgatatgtaaatttgcgttaacgcaaggtttgagattgggcaatgctggtggatatgtccatggttgcggtcggatagtggatactttaacttggttcccgatggcgtgagcaagcaccccgcacacaacaaaaagggcggggatcttgcgatcctcgccctttatttccgaactacctagcggtatccgttcagtgagtcagactcacttcttggacatctcggtgtaggtcgggaggttctgccaatcgaaggcgtagccggacttcacgttgagggaagccacaccggaggcgttggagtagtacagcgggatggccggaaggtcgttgaggaggatttcctcagcctgctggtacagcttgttggcgtcatcagtgctggaagcggcagcagcctgcttgcacaggtcatcgaaggccgggctcttgtagtcaccatcgttggagccgttgccatcagcagcagcggtggagtacagctgccacaggtagttctcggcggacgggtagtcaggctgccagccggtacggaaggcgcccttcatctgacggttggtgaccgcgtcacggaattcctggaaggtcgggatcgggttggtggccgcgtcgatgcccaagttgttcttgagctggttcacgacggcgtcgtaaagcggcttggcaccaccatcggcgttgtaggagaaggtgagctggccgtcgtacttggagatggcgtcagccttggcccacagttccttggccttggaggcgttgaacttcaggttgtcggcacccttgagggagtcagagtagcccggggtcttcggggaggtgaactcggtggcggcggtggcgttgccgttgagcaccttgtcgatgagctgcttgcggttgagggccatggagatggcctggcgacgcagctggccttcctcgtcgttcttgaagtggtcaagggaggacgggatggtgaaggtctggatgacggagccggcctcggagtaagcctggaccttcttgtcggtcttgaaggtcttggtgaaggcggccgggacggactccatcacgtcgaggttgccggcctgaatgtcgcggtaggcggcggagtcgtcggtgtagaccttgaaggtcacgccatcgttcttgacgtcctcgttgcccttgtagtcagggttcttgacgagggcgatttccttgttgtggtcccacttggagaacttgtacgggccgttgcccacaggagcctcgccgaaggccttcgggtccttgtagaaggactcaggcagcggggcgaaggccgagtagccgaccttaatcgggaacacggagtcggactggttcaggtcgacggtgaaggtggtgtcgtccacgaccttgaggccggagagctgctcgtcacccttgaggccatccttctgcagatcgtcatagccggcgatggcggagaagaaggaggagcacttctgggcgttcttggcgttggccacgtaggaccaggccttggtgaaggactcagcggtcaccggagtgccgtcggtgaacttccagccagacttgatcttgatggtgtactgggtggcgtcatcgttcggggtgatggactcggccacttcgttggaagccttgccgtccttgtcgaaggagaccagacgggagaacagcaggtcgaccggcttgccgccgccggtttcgttggtgttgcccggaatcagcgggttctgcggttcggagttgtacgcagtgatgatgttggagccagcggtgtcaccggaggcagcgttgctgttggagccgccgcaggcgctcagcagcatggccacggagcaagccatggcagcgaaagcaagggctttcttcttcatatgttttctcctattcattaggttgcgaagcgtttcagcctcgcctcatgcgaacggggtcggatttcctcatcgtcgggacacttacgcttcccgctgcttcggacacccaaccccgttgctgttacctgtcatttttgcgcacttgggagacaagcagcgtatttttgttacacccatgtaaaattcgggggcttttaccggctaggttcagtctttgctaagtttgttaaccaatgcccacatagtggtcatgcccggggaaaggcctgtccgtaacggttcttgagctgctcgatggagacgtgcgtatagcgttgtgtagttttcaaggaggaatgcccgagcatctcctgcacctccctcagatcggcaccgccgtccagcatgtgcgtggccgccgaatggcgcaacgcatgggggctgatgtccggtacgccggcctctcgggccgctctgtgtacgatgtcacgggctatgcgttggtcgatacggccgcctcgtgcgccgaggaacagggcgttggtagcacgggacttggctgcatccgttgccgtacgggccagtacaggccgcccttgttcaagccaagtctccagcgcacgctgggcgggcagtccgaacggcaccacgcgttgcttgttgcctttgccggtgactttgatggtgcgattggagaagtcgacgtcaacgatatccatcgacaccagttcggcgacacggatgccggtggcatacagtagttcgagaatcgcggcgttgcgctgcgattcggcgacgactcgggcgctgtcgcgcttgtctgcacgggcgggtgcctcgttgcggtttacggtgtcggctgacttatcagctgtcttgccgactgccttgccgctgccactgccggacgcggctgccgctcccccatcgcccttgtactggtttgttgcaacggcctgttcggcgacatccaataactgctcagcttgagattcggtgagcaccgcgggcagcgtgctgggaatcgagggagtcatcagtgtggcggccgggtcggtgttggtcaccccatgctcataggcccacgcgaagaacccgcgcacggccacggttttgcgggccatgctgctgcgggcgtgatcgcgcgattccaccgccatccagctacgcagatcatccagcgtgatctcgttcagatcggtcacgccgcgcagctcgaacaggtgcagacatgccgtgagatccgcgcgatacgctttgagcgtattcgctgacaggccgcggttggacttcagataggagacgaaggagtcgatatcgccgtcgaactgcgtagatgacactctcgttctcctccgaattctttatggccttgggttacggccggggtggcgtgttgcgccgctccggcacgggtttcaatgtggcaatctgttcctgatggatggtcacgttctgggccgggcgcgaaccattggcggcggcgtcacgcaccatctccaacgtgtatccgtcccaggaaaccacgtgacccacatagtcgcggaacttcatacggtggtcgaccgggtcaatgccgtcggtgatgcgcaccaccacgcgggcaccggccggaatctgccttggtaacgtcatacgtcatcatcccccttaaccattcgccgcatcaacttcgatgcgtttcccgaaaaacggtacagactaccttactcctttgagcctttcgaacagcggagccacacggtcttctcacgaaaacaagcgggaacttcatccccctcgcgcggccttcttcgtgacaggcggcgaggggaacctgcgcacgggcctacatggcggtacgcagttacatggcggggcgcagttggatgatggcctgacgtggatggacgaagccggtgatggcttctcctcggcgtgcggagaacagcagggtctgctgccagccggcttcggggacggcgagctcgcgttccgggaatccggcggcagttgtgccggcttgcggcgcagcggtggccgtatcgtcttgtgcagcggtgatgccggcatgtgtcacggcggccttgtaccggcggaaggggtcgccttcggcgaagaatcccatcacatcctgctcgccggcggcaccagcgtgcagttggtcggccatatcggtcagacgtgccgccatgcggcgcagcagcgcttcgacgttcagcgagtcttcctcgaccatcgcgcgcgtgcggtccgggtcggtcagggacacgcgggtcatgtccctccagcagccggcggccagcgcggcggcgatgttgcggtccgggttggcgaccagttcgttgatcagcgcggtggacaccacatgcggcatgtgggagatcatcgccgcggccttgtcatgcgtttcgtcgtccacgacgatgacgcggttgccgacgtccttggtgatcatcgcggcgacgtcgaggaagcggcggtagtccgtggactcgtccacggtgatggcccatagggcaccgtcgtacagatgcgggtcggcggcctgccagccggacagttcgttgccggccatcggatgggcgccgacgtagcacttccccagcccggcagccttgacctgatcgcggaccatgcccttgaccgagcccacgtcggtgagcgtggtgttcggatgatcgcccatgagcggggccagggcggcgaggattgcgggcatcgccttgagcggattgcacagcacgaccacatccggctcggcatccatgagttcggagagcgtgctcttgcagaaaatgccatcggcttcggcctgggcgtaggggtgcgggcgatggttccacgcgacgacgcgcacgccgcgctcggtcaggcggcgtgcgagcgagccgccgatcaatccgagtccgacgattccgactgtatctaccacagtagttccttccttgcttcctcggtgtactgccagccttccggcgcgcgattggtgatgtggacgccgccctcgggcagcatccaggcgtcgaccggcgggttcgggcgttcgcggcgtgggtagacggccagggtttttgcccagtcgccgtgtccggcgatctcttccagtgcggtgcggaatctcggctcccagggggcggcgtcaagggtggcgatgaagctgtaggttccgtcgtggcctttgatcgggcgcgagatgaagctggtcatgttcagtcccgcatcgcgcaggacgtccagcaggtcggcgagtacgccggggccggtgaccagcgggatgaaggtgatgatggtttcgaagtcgccggcgtcattgctgtgggcgcgggcgttgagttcctggaccacatcacgcggggcgatgacaaggaattcggtgtgcgcgccatcgaaatcctgcacatgttcggcgagggtgtcgagatcgtagagttcgccgcagatgctggggccgagcgccacgcggccgggcttcaggtcgcggcaggcggcggcgttggaggatgcgggttcgggctgcaaatggtgttcggcgatgaaccgggtgcattgggccagaccgtgcgggtgggcgctgacggggttgccggtgcagtcgtagatgctgtggccgcgcacggtgaaggcgttgaaggccacgtccacactgatccgggcgaagccggccgcgttgggggcgtcgatcagcgcgtcgagattcgggaccacatagccttcgacgttgttttcccatgcgatgacgccccagccttggcgcgactgtacggcctgcatgatcgcgggcacgtcgggcagagcgatgaggtcgaagtcgccgagtgtggcgaactggtcggcggccgtcattgccgcctgatgggtgaaggtgccctccgggcccaagtaaaacagtttcatgcgtgccataaagttctatggtagcggccgtaatcccctacgcccgccgatacgcgacgcattcccgggaatgtatcgccatatatagttacgcgcgcgattcagaatgagtgggaatgacgaaccagcgggcgggaagaatgagcaggacgacttggaccagtatcaggccgtacagccagatgtagccggcatgttgggagaagaacggcatgtcgccttggaatccggcgacgatgagcgctttgccggatgtggtggtcagcgccatgccccatgcggtcagtgaggaggcgatgaggtgcagggccagtccgaccgcgcccatgcgcgaacgggcgcaccatgtcgataggccgatcagcagaaacgccagcaccagaccatacggaatattcagttccgcacccatacggtgggcgaacgtgcccacaaaggcggaagccacgcccgccgcaatcgtgatcaacgatttgaccagcgcgttctggcgatacgaccacggacgcaattcagtagtgctcttcacagtcatgcgtttcagtataggtggggatatgacttggtgaggaataaacttagctcccctcagagaggggagctagagagaatggtcggctacagccgcaccaaatcacttaccctgctgggcggcgttctggcggcgctgcttggcgcgccacttgtaccagtcctcacggccgaggatgatcttgcgcacgcggatggactccggggtgacttccacgcactcgtcctcgttggcgaagtccagggactcctcaaggctcatcttgatcggcggggtcagggtttcgagcacgtcagcggtggaggaacgcatgttggtcatgtgcttggccagcgtgatgttcacgtccagctcgtcgggcttgttgttcacacccacgacctggccttcatacaccggggactgcggttcgacgaagaagttgccacgggcctgcagacgctgcatggcgtacggggtggcgatacccttgcgatcggaaaccatggaaccgttctggcgaatggtgatggcgccagcccacggcgcgtagccggcagagatggaggaggagatgccggtgccacgagtggcggaaagcagcgcggtgcggaagccgatcagaccacgggacggcacggtgaactgcagacggacccagccggagccgtggttggtcatgccatccatacggcccttacggtcggccatgagctgggtgacggtacccatgtactcttccggcacgtcgatggtggtgttttccatcggctcgttgatcacgccgtcgatcttcttggtgaccacctgcggacggccgacggtcagctcgtagccttcgcggcgcatctgctcggcaagcacggccagcgccagctcgccacggccctggacttcccaagcgtcgggacggtcggtaggcagcaccttgatggacacgttaccgatgagctcgcggtccagacggtccttgatcatgcgggcggtgagcttgtggtccttgccctcggtgccggccagcggggagtcgttggtgccgaaggtcatggagatggccggatcgtccacatggatgagcggcagcggcttcgggtcgttggggtcgacgatggtctcgccgatcatgatgtcgttaacgccggcaacggccacgatgtcgccggggcctgcggattcgaccgggatacgctcgaggccctgggtgcgcagcagttcggagacgcggaagttctcgagggagccgtccacacgggacaggccgtaggtcttgcccttctcaagggtgccgttgtagatacggaccagaccgagtcggccgaggaagtcggaggagtcgatgttggccacgtgagcctgcagcggggcgccctcctcgtattcgggggccgggatggtggagatgatggtttcgaacagcggctcgaggttgtcgttgtccggcaggccaccgtcggcgggctggttcacggaggcgtagccggccttggcggcgcagtagatgaccggcatttcaagcagctggtcaaggtccaggtcgatgccctcgtgctgcacgtcgtcggccaggccgagcagcaggtcggaggtttcgccgacgacctcttcgatacgggcgtcggggcggtcgaccttgttcacgcacaggatgaccggcagcttggcttcgagggccttgcgcagcacgaagcgggtctgcggcagcgggccttcggaggcgtccacgagcagcacgacgccgtcaaccatggagatgccgcgctcgacctcgccgccgaaatcggcgtggccgggggtgtcgatgatgttgagggtgatgccctccgggtggccgtacttggcggccagcggaccggtgtattccacggccgtgttcttggcgaggatggtgatgcccttctcgcgttccagatcgttggaatccattacacgatccggcacttcctcacgctcggaaaacacgtgcgactgctgaagcatggcattgaccagggtggtcttgccgtgatcgacgtgagccacaatcgccacattacggatatctccacgaaccgccatcgaaacctctcttaatactgattcttttgcgtaatcgttcggtacttgcgttctcgagtacttaagtacttactctgaggtgtttattcatacctacacacaaaccgtcacgatggtactcgcacaccttgactatgtcggaacatagaaaagcacctcacaacggcagaactcccgcgtctcgacgaacccctcacgggatttctgccgtttttacggccttcaaacggcagaacccccgcgtccctttcgccgggacgcgggggttctgccggtaatcaggcaaatatctgttctcccgtcatcgacttccgtcagtcttcgagatcgaggcctttgcgttcgggcaggcagagggcggcgacgcaggcgatgatgaaggcggcggcgaagatgatgaaggccacggccttgttgccgccggacagggtcaggaaccacggcatgaggagcggcgcgatgatggcggcgatgcggcccaccgctgcggcggcaccggcggccgcgccacgcaggcgggtcgggtagatttccggggtcacggcgtacagcacgccccacgcaccgaggttggaggcggacagcagcatgccgaacacgagcacgagggccacagatccggcctgcgagaacgcgaaggcggccacggcggagacggccaggaagatgctcagcgtcttgcggcggccccagacctccaccagccaggcggctaggaagtaaccgggcagctgggcgatggagatggcgagcgtgtagccgaatgacttggtcagggagccgaactggtcggcgagcagcgacggcatccatgtgaacgcgccgtagtaggagaagttcacgaagaaccacgtggcccagatggcgatggtgcgggccaggtacttggagccgaacagttcgcgcgtcttgatcttcggcagcggcttgcccttgggagaggttaccggggctactcccccggcttcctcgaagtagcgcacggccttttcggcttcgtcttcgcgacccttggcttcgaggaatcgcacggattctgggatgtgcacgcgggtgacgattgcgtagagcagtggcagcgcgccgatggccagcgcccagcgccagccccagtcgccggtgttcgggatcacgaagtagccgatcatggcggcgacgatccagccgacggcccagaacgattccagcagcacagtcatgcggccgcgctgtttggtcggcgaaaactcggagaccagcgtggaggcgaccggcagttccgcgcccaagcccagtccgatgatcagtcgggcgccgagcagcatgccgagtgaccaagatagggccatggcaccgttggcgatgccgaagataatcagtgtggcggtgaacacggttttgcggcccacgcggtcggcgatgaagccgcccactgccgcgccgatggccatgccgacgaagccgatggacagcacccatgacttttcggtcggggtgaggttgaagtgcgggtcggcggcgatggcggcgactacgaaggagacgaggccgacgtccatggcgtcgaatgcccagccgatgccggaggcgacgaggagtttgcggtgcgccttgttgaagggcagccggtcgaggcgctcgttgcgggtgagctgcgcgggttgcgctgaagtggtggtgctcacgtcgtttcctttctggtaagtggcgtcagatttaatggcgggtcaggtcggtgtaggactcttcgatggccaagctgatgcgttcgacttgttcgcgggtcagcggcttgcggaaggtcatgcgtaatgccgatttggcgatggacggttcgaggcccatcgccagcaacgtggcaggaatctcgtggcgcccgatggcgcaggccgagccggatgaggcagcgatgccgcgcgcgtccaggtcgacgagcagcgcttccccggtgacgccggggaagatgaaggaggcgtgaccgggcagacggcgttcggggtcgccggtcaggtcggcgcgaggcgcgacccggcgaaccgcgtcgatgagcatgtctcgggacgcgaccaactcacggtactgcgcctgcatgcgcgcattcgattcgttgagtccgatggcgagcgccacggcaccggccacgttctgcgtgccagagcgcaggccgcgttcctgcccgcctccggacagcaccggttcgatgggtgtgcggccgcgtaccagcagcgctcccagacctttgggggtgccgaatttgtgtccggatacggacagggcgtccacatcccagtcacgaaaacgaatcggaatctgcccggcggcctgtacggcgtctacatggatgggcacgccgtgcgcgtgggcgatgcggaccagttcctccacgggttccacggtgccgacctcgttgttggccagcatggtggagaccatcgtggtacgttcactggcctcgccgtcgagctcgcgttcaagtgcgtcgagatcgagatgtgcttgcgcatccacgggaatgcgcacgacttcgaaaccgaaccattcgtgcagccatgccgccgattgggccacggccgggtgctcgatagcggaaatgataatgcgcgggcgacaatttgccggctgtttgccatcggcttcggcgaatccgcagaccggccgcaagcccagtttgcgcatgcgcgccatggcgatgcctttgatggccagattgtccgattcggtgccgcctgaggtgaagatcacgtcatccggccgggcgcccaatgccgcggcaaatgatgcgcgagccgcgtccagcgcgcgggccgcggttttgccgggctggtgcacgctggccggattggcgtaggcctcagtcaggaacggggtcatggcctcgatgactgccgggctcactgattcggtggcggcggcgtccaggtacagttcgccgggttcaccggatgcgttgggggtatcggccatgactagttccaatccaatccgaggtcgatgctgcgcacagagtgggtgagcgcgcccacggagatcacgtccacgccggtgacggccacggctggcactcgctccaggctcatgttgccgctggcttccacgatggccttaccgtcgatgagctccacgccgcgacgggtgtcgtcgagcgagaaattgtccagcatgatggtgtccgctccgccgacgagcacggcgggaatctggtcaaggcggtcgacttccacttcgatatgcgtggtgtggcccacctgttcgcgcacgtggcggatcgcgccggccaggtcgatgccgcgcgcggcgagcgccgccagatggttgtccttcatcatgaccgcgtcggacagtccgtaacgatggttgtggccgccgccgcagaccacggcgtatttctcgaacgggcgcaggccgggcgtggttttgcgcgtatcgacgatgcgggtgcgctcgtagcggcgcggccgggtgacgggtccgtcataatcatcgccgtagatggcgttcaccgcgtccacgaaggcggcagtcatggtggcgatgccgctcatgcgctgagtgaagttgagggcgatgcgctcggcggtgagcaggtcgcgtaccgggcctttcacggtggcgagtatctggccgcgctggaatcgctcgccgtccttgatggcggcggtgacggtgacggccgggttctgtgcggcgaaggctgcggcgaacacgtcgatgccgctcatcacgccgttttcgcgcgcggtgaggtgggccgagccggtttcgtccgcggggatggtggtctcgcaggtgatgtcgccgtagggcgcgtcttcggcgagcgccgcttcgacggcgacgcggatgatgtgtgatgtgagcatgggtcagtccttgatgtaggcgacggagtgggcccagttgtcgactggctcgctgtggtcggtgcgggcgtgggcgcctctcgactcggtgcgggcgagcgcggcggtggcggccacatagcctacggtgagcatgttgcggttctccaaagcctcaacgctgcttgcagcaccatcggcgtttacatcagcctgggcgtttgcggcggcgaggccttggccgagttcggcgatggcggttttcagtccggcctcgtcgcgcagcacgccgacgccatgccacatggtgttctggatgcgggtacgattccacaccttgtcggcggcggtatcgtcagcagcagccgtagcggcaggggcggccagcgcgatcggcgcatggtcgaacacggcaccggtggcggagttcaggaacggttcgggtgcccagaccgcgtcgtcaccgtccgcgacggcggccagaccggcgcggcgtccgtagacgagcccctcgagcagcgagttggaggcaagacggttggagcccatgacaccggtacgagcgcattcgccggccgcatacaggccgggaatggaggtccgggcgttcagatcggtgcgaatgcctcccatgtagtagtgcgcggcgggcgccaccggaatcggctccttgctccagtcgaagccaagcgaacgcgtataggcgtcgatggtcgggaatcggtgggccaagaagctggccaggtcggggttctcgcgggccatcggcgagacgtcgagcatcacgggcttgccgccttgcgcctgcatcacgcggaagttctcgcgggccacgacgtcacgcggcgcgagttcggcgcgcggatcgatgtccttcatatacctgtggccatgctcatccagcagcaccgcaccttcgccgcgcacggcttcggagacgaggaagtgctcgcccacggccatggcggtgggatggaactggtagaactccagatcggcgacctgggcaccggcacgccatgcgacggcgaggccgtccgcggtggcgaccggcggattggtggtgtacgggtacatacggcctgctccaccggcggccaagatcacccggtcggcggccagatccttgtcctgcccgtcgatcagcaggtggacgccggcgatgtggccgccccgcacgatgagatctttgaggaaggcgttctcgatgatgtggatgcgcgggttcttgcgcaccatggcggagacgtccagttcaaacactttgccggtggcgtctcccccggcatgcaccacgcgggcgcgcgaatgagccgcttccaggccgcgcagcatgtgtccatgcgcgtcgcggtcgaagtggacgccggccgcggcgaactcgcggacgcgctccgcaccctcacgggtgaggatgtccacggccttcgggtcgcacaggccgtggcccgcggccatggtgtcggcggcatgcagcttcgggtcgtcgtcggagaagatggctgcagcgatgccgccctgcgcatgataggtgtttgattccaccagttcggccttggttaccaaggtcacgtcgtgtccggtgccggccacggccagtgccgcggacagtccggcgacgccggcgcccacgacgacgatttcagtgttgctcattgtgttgctttcctctgtttttgcgtcatctgctcccttcagtccgctacgcggacagctcccctcatgtacgaggagcgccagggacgaatcacgggtgaacgcgcagcatgcgctccagtgccaccttggcttcgcgggcggtgtcttcgtccacggtgatgcgattgaccacgttgccggcttcgaggttctccaaagcccaagccaggtaggccgggtggatgcggtacatcgtggagcaggggcagaccacggggtccaagcagaacacggtcttgtccgggtactgcgcggccagacggttcaccaggttgatttcggtgcccacagcaatggcggatccggcgggcgcgttggcgatctccttgacgatgtacgcggtggagccagtaccgtcggcggcatcgaccacctgcatcgagcactcggggtgcacgatcaccttgacgcccgggtatgacttgcgggcacgttcgacctgttcgacggtgaaacgctggtgcacggagcagaagcccttccacagaatcatcttggcgcgggcgtaatcggccggatcggcggcgccgccctgtgccttgaacggatcccacagcggcatctcgctcagcggaatgcccatcgcgcgggcggtattgcggcccagatgctggtccgggaagaacagcacgcgcttgccgcgggcgaacgcccattccagcacggcgtgcgcattggaagaggtgcatacgatgccgccgttgcgtccgcagaacgccttcagcgcggcggatgagttcatgtaggtgaccggaatgatctgctgcaagccatcggagtccggctgggtgccgcagatctcgccgagctggtcccagcattcctggacctggtcgatgttggccatatcggccatcgagcagccggcggacaggttgggcagggtcacgctctgttcgggcgtggagaggatgtcggcggtttcggccatgaagtgcacgccgcagaacacgatgtggtcggcgtccgggcgttcggtggcgttcttggccagctggaaggagtcgcccacgaaatcggcgtgcttgatgatctcgtcacgctggtagaagtggcccagaatcaacagtttggagccgagacgctgcttggcgtcggagatgcgctgctgcagttcctcgtcggaggccttgcggtattcgtccggcaacacctgctggcgcggcgcgttggcgggcagacggtcgagcatcgaggcaccgggaccgtagctgggtgtggtggtgtcgaagtgccatgggtcctgggtcagtcctgcatcgcaggtgctttgcgcgcccagcttggcgatgatctcgtcaacggacggcgcagtgaatagtgcggtcatagtggttcctttcctatatacgtctgtgataccggcccgaagcgggtcggcgggaaaaatcagatgcgcgcggatgggatcagcgcgtcgagagcgtcttcacgctcgccttgtctggacagttccacgatgtcgtcaccatcggattcgtggggcgtaccgttctcgacaggtcgtttggggatgtagcggtagacggtggccggtcgttggcggccttcgcgcatcttctccccggtgtcttcaaggtcgcccgaggcaagcattttgcggcggaagttcgccaagtcgaggggttcgccgccaatcgcctcatagacgccgtgcagttggcgcagggtgaacgtggggccgagcagtcgggtggccacgtcggagtattcgattttggagcgcaggcggagcagcgcgtagtcgatgatctggcgatggtcgaacgccagctcgggcagttcgtcttcggggaaccatcgtacgttgtcaccgtcctcgaagcccgcggcctcggtctggccgacgagcgcccagtacacgacggataccatgggcaatccgccatgggaccgggtcgggcctccaaaggtgtacagctgttcgaggtatcgcgggtgcaggtctgtggtcgattcgagggccgcgtaggcagactgttccaacgaccggtcggagcgcaggtcaccgccgggcaacgcccagcagcccaggaacggctgacggacgcgcttgaccaggggcaaccagagacgggaatgggccgagttcgcggcgttgccggaatcggcggcactgttgccggtatcgccttccgggccgagtgccagaatcaccactgacacgccgacctgtggcggtgcgctgcggcgctcggacacattgccgaatcccatgccatgcctctttccataccggttgttctccctgcattgagagcatagcactacttatagtcacaatgaccataaatcacatatcggatggtctagcgcacgaatattggtcaggcagcgggccccaatcgctacgaaatcacgtccgtatcttccgatttcgactgtgtcatttcggcgacggacgggaggaatggcgctagggagggtagttcgtcgagactcttcagacccatttggtcgaggaagaattcggaggtgaccaagagggccgcgcgggattcggggtccacgccgtcttccttgataaggccgcgtaccgtgagcgagcgaatcactccatcggagttgacaccgcggatcgcggccacttgggctcgggtgacgggttggcgataggccacgatggcaagcgcctccagtgcggcctgactgagtctcgcagtctggccgtcggtgacgaatgatgagacgaccggctcgaacgcggcgcgactggcgaactgccagccacgagcggtgcggcgcagttcgaagccgcgcgggcggatgtcacgggattcatcgccctcatagtcatcgtgcagggctcgcaatgcctcttcgactgtgttgcgatccaatgccaaaatacgggccagctcggtggcggtctgcggctggtcggcgaccatcagaatcgcttccagacaggcgggcagcccgccgggaaaatcgtctaccgcgaaatccacgtattcggggtgagtctcctccactcccctcaccgcggcctttgcggattcagccgtcgattcggcatccgccatgtgttcggttgcattcgttgcgtcaatctgttcagtcaccaatcgccgtccttacgcaaaatcaccttcggaaatgttcacgtcgctcatcgtttcggctacgccgggtacccacctcaggtgcagttcggcaaacggaccatcttgctgatactgcagcacaccttgtttgaagaacacgagcacggccatgaaccgagccaccacctcaatacgagaagtgcagtcccgggtcaattcgctgaacgatatcgactggtcgcccttggattccaatgccgcgatcagccggtcgcgcaccaccagcgattgggcccgcagatcgaccaacggcacgtgcagctgatggatcgacacttcggaggcgggcgcgttggcgatgacctgggcggtcagtcgggcgagttcgagcggagtcagcgtccataccagctcaggcagcatggcggcaacgccctcgtccatggccgccgggtgcgggaatcggccggagttggcggcgatacgcgcccggaagtcacctgcggcctgcttgtaggcgcggtattggaggagtcgggcgaacagcaaatcgcgttcgcgcagcacttcgaggctctgctcgtcgtgctggctgtcttcgccgccgggcagaatcgccacgcttttggcctcgaccagaatagaggcgatatcgagaaaggcgctggcctcatccatgttttttgtgaaatcgagcccgcgcacgtatgtcaggaattcctcggtgatcgaggagagggaaacttcggtcagctcgagtctgttgttggcgatcatgccgagcaaggcatcaaacggaccggaatagacttcgaggttgacccggaagccggaagtggcggattcctccgtgctgatttcggcttccgcggagctcccctcagcctcgctacgcgagccagcttccctcagagaggggagccgagaaagggaagtctcattcatcgtttatcgaaacaatcgttacgccacgatgccgcgagcaatgagctcacgtgccacctcacggtattcctttgatgtcttgtgctcaggggcatagaccaccacgggcgcggcggcaaccgtggaatcgggcagtttgatggagcgggagatgaacgtgtggaacaccttttcgctgaacgcctcgtaaacgcgctggcagacctcttcgcagtgcagtgtcttggtgtacatggtgatgagcacgccatccacttccaatgcgggattgatgcgggactgcactttttcgatggactgcataagcagggccacaccgcgcaaggcgaagaattcggcggccacgggaatgatcacgccatcagctgcggcaagcgcgttcacggtgagcaggccgagcgatggctggcagtcgacgatgatgagatcgtattccgacttgagcttgcgcagcacgctgttcaggatctgctctcggcccacttcggtgaccagctggacctcggcggcggacaaatcgatgttcgccggaatcacatcgatgttctcgaatgcggtgtgctgcaccacatcatgtgggtccacggaaatatcgaacagcgcggtgtaaatcgtgttctccacggtattcgcgttgacgcccagtcccacagtggcggcaccctgcggatcgaaatcgacgataagcacgcggcggccatactgggccaacgcaccggcaatattgatggagctggtggtcttacctacgccacccttctggttgcacatggcaatgacacgcgccggaccgtgctgttgcagcggttcgggtgcggggaaggtttcgtattcacgtccaagcaaatcggtaggcatactgtctaccttatcaacatccgggttcgctgggggtgcaacgacatacgttcctgtcataggcagcgttccttgacggaatgcgctgtctttatcgcgggtatctcgccagtcgtccatcgttgccctcgccccctttgtcgggaatacctgctcgcccatcctaatgtactcgccgggctcgcctcggaacaccgttttgccgctggtattccagtgttccgaggtttatggatctcgtctcgtactatgtcgatgcgcttactcggtgcgcagtgcggtggccgggtcttgcttggctgccttacgcgagggaatcaggccgccgatcagcgtgagcaccacgcttaggatcaccagcaccacgccaccggtcaccggcagggcggcattgacgtccgcattgccgatgaagtggtgtagcacggcgttgatcggaatattgagcagcacggtcaagcccacgcccaacaggccggagcataggccgatgatgccggtctccgcattgaacacctgggatacgttgtgcttcgaggcacccattgcgcgtaggatgccgatttccttggtgcgctccagcaccgaaatgtaggtgatgatgccgatcatgatcgaggagacgatcagcgagacggacacgaacgcgataagcacgtaggaaatcacgttgacgatggtggtcaccgaactcatcatgagcccaacgtaatccgtgtaggtgatcttgtctttcttcgagacggtgttgttgtagtcggtgatcgcgtcggcgatgtggtccttgtcttcgaagctgtcggcgtagatgttgatcgagctgggcgcgtcacgactcaccacaccgaatgcggcgaggttgtcgtcgtaggtgccggtcgacacgtactggtcgtagatcgcgacaagcacgtcgttcgaagccgtggcgatatacgcgtcgaaactgtcggcgagctgctgttcgctcatcgcggccatggcggcggcctgatcgccggcacccgccgcgccagcgacacctgcagcaccagcaccagcggcgtccgatgcgcccgtgccggactgctgcccggcgctcatcatcgacttggccatgttcgccttctgcgtcacgcccagcgaagccacgtaggtgcgcgcgtcggccaccttggtggcatcgtccgagggcgagaacgtcatgccgttgagcacgttcgtgttcgggttggccttctgatcggtaacgatggcgctggaggccgcacggtcgatcaaatcattggtcagagcgcgcgcgtaccccacaccagcggccaacggcgtggccgaagcatccttcttcgccttgacgacgcccaccaccttgagtttggtggccgtttcgaggcgctgttcgatttcgtccttgtcgttgccgatgaaacggtagtggccgtcatcgcccttgacgtactggtcggatgccggaatcatgtacagcgtctgatcgagggccttagcatagtcgatcttgtcttgtggagtgctgaccttgtcgccggcgttgagcttggacatcatctcgtggtaatcggaggcgggcagcaggccgagctcgtacagcgtggtcagcggcacgctgttgttgtcgtcaagcaccagcaccacttcatccttggacttcggccatgaaccgttgaccacctgatagttgtcggtgataaccttgcctacgagcttgctgtcgtccgctcccggcatgatctcgttgaacgagtcgggcgcggcgttctcatcggttttgccggtcagcatcgacatctgctgcgaggtgatcgacgaggtgccggacatgccggacgagcttgtggacgccatctgcgaggccatcgaggcagagtcgctggatccgatcgtcacgccgtccgcattgaccagcgtgccgtcggggtcgtggtcgaacacggagaatttcacgtcatatgtgtactggatgccggtggaacccacatactggtgaatctcgctcttggaattatccaggtatttcttgaagcgggtcaggttgttttcggtaatcgaactggtcaggctggacgcctgcttgacgctgcggtcgtccgggtagatgccgtcggttttgtgcgtcttgccgccgtatccgtcatcgccgcccatctgtccgcccatcatgctgctcaggtcgaaggtctgggagtcgacggtgatcgggtaggcggtcatcgtgtcacgctggatgtcactgatgtatgtgttcacgccagtcgacaccgatagaatcagcgcgatgccgatgatgccgatcgagccggcgaacgaggtcagcagggtgcgcgccttcttggttttcagattgttgaagctcaacgccagcgacgtggcgaacgacatcgacgcgcggcccatcgtcttgtacacggccggctgttcggccgtctcgtccacgacgaacgggtcggagtcggagcggatcacgccgtcgcgcaggttgacgatgcgcgtggcatattgttccgcaagttcggggttgtgggtgaccatgaccacgaggcggtccttggccacgtccttgagcaggttcatgatctgcacggacgtgtccgaatcgagcgcgccggtcggctcgtcggccaggacgatgcccgggtcgttgaccagtgcgcgggcgatcgccacgcgctgcatctggccgccggacagctggtttggcttcttgttgatgtgttcgccgagtccgaccttctccagcgccttgcgcgcacgttcgcgacggtcggccttgccgatgccggaaatcgtcagcgcgagttcgacattcgacagaatcgtctggtgagggatcagattgtagctctggaacacgaagccgatggtgtggttgcggtacgaatcccaatcgcgatccttgtattggcgcgtcgagatgccgttgatcaccaaatcgccgtcgtcataccggtcgaggccgccgatgatgttgagcaaggtggtcttgccggaacccgagggacccagaatcgcgacgaattcgctgtcgcgtaggttcaggctgactttgtcaagcgcctgctgaacgaaatcaccggttttatagcgcttcgagatcgatttgatctgcagcatgaatacctcttcctggctgacggttcgctgttatgtactgtattgtcacgccttgaatttccggccgactttggtgctcccccgccgcgattccgctatgggcggacgcgtcgcaaaatggtgtgtctcaccgcgctctgggatgtgaggtcagatacgtttcgatcagggtttcagggcttacgtgcgtgtagatctgcgtggtggtcacgctggcgtgcccgagcagttcctgcacggtgcgcacgtccgcgccgccttggatcaggtgcgtggcaaaggaatggcgcaaggtgtgcggatggagtggtttggtgatgccggcccgctccccggttgctttgacgatttcccataccgattgccgcgagatgcgcttgccgcgtttgttgagaaacagtgcgcgcctctcgggaatcttggcgctggagcgctgttccaactcgccacgccccgcattgaggtatgcggtgatggcccggcatgcgtaactgcccaatggcacaagccgctgcttggagcccttgcccatgagtcgcgcgatgtgctcgtccaggtcgatgtcgtccagattcgcaccggtggcttccgagacgcggcagccggtggcgtacatgaattcgagcagggccttgtcccgtaataccaccggatcggttgagccgccgactgccgccgcgtcgagcagacgggttacctcgtccacggtgagtacgtcgggcagggtgctggcgcctttgggcgccttgactgcggccgaaacatccgccgtcaccgcgtgctgaccgagcgcgaaacggtggaattcgtggatcgaggccagtcttcgggctttggagcgggcggactcccccgcctggtcaagggcggcgatgtagtcttcgacgtcttgtttggttatggcgtccggttcgtggatgccgcgggtttcgagccaatcaatgtatttggcgatgtcggattcgtaggcggtgacggtggccgtggcgagccctcgctccacgccgatgtggacgaggaactgctcggtgagtctggtgaatccgttggtcatagtgcccatggtacaaagaaaccccgctcggaagcggggtttctagtgtgaagtcacgacttcaagcaatcaggcctcaaccggagcgttgacgtcctcaggcagggcggccttggcggcgtccacgatggtcttgaaggtgtccgggtcggagacggcgatctcagccagagcgcgacgatccagctcgatgccggcgagacgcaggccctggatgaagcggttgtaggtgatgccctcagcgcggacggcagcattgatgcgctggatccacagcttgcggaagtcgcccttgcgagccttgcggtcacggaagttgtagttaaaggagtgcagcagctgttccttggccttgcggtacaggcgggagcgctggccacggtagccggaagccctctcgagaacaacgcgacgcttcttgtgggcgttcactgcgcgcttgacacgtgccataatctattcctcagctttctaaagtcttgttatttccgggtaagccctatgctcacttctgcagaagctggtgcagcttcttggcctggccgccgcgcagcacatcgtcggcggacagttcacggcgcttgcgagcggacttgtgctcgaggttgtggcgcatggcggaaccgacatgcttcaccttgccggtgccggtgatcttggcgcgcttggaagcggcggaattagttttcatcttcggcattgctgccctccttgctggtttgcttcttgtcggaagtcttctgagaaatcgcggactgcgcgtcggccgcggcctgagcctgagactcctgcttggccgcgagacgagccgcctggcgagcctgacgctcggcgcgggactcggcgccacgacgacgctgctcggactgggtgtgcaccttcttgcccttcggcgcaagggtcatgatgatgttgcggccctcctgcttcggcttggactcgacggtgccgtattcctcgacatcgtcggccagacgctgcagcagttccacgccaccaatcgggcgggagatctcacgaccgcgcaacatgatggtgaccttgaccttgtcgcctccgttaaggaagcgggtcacatggcccttcttcacgtcgaaatcgtggtcgtcaatcttcaggcggaaacgaatctccttgatttccgcggtgctctggttgcggcgagcttcacgagccttgatcttctcgttgtacttgaacttgccgtaatcaatgagcttggcgaccggaggcttcgcgttcggggccacctcgacgagatcgaggtttgcctccttggccaggttcagcgcgacggaagtcgcgatgacgcccacctgctcgcccttcgggccgatcaggcgtacctgcgggacgcgaatctcgtcgttaatacgtggttcgtcgctgatgatgactccaatcctctacttcaattccgtggcgagggcctttgctggagtcctgttcaatgctttgggttcatggcaagccaaagcccgcgccaatatgcgctcagcttctgcagacgcatatcagttctttgcgtcattcctgattacgcgttgtatatcgcaatcgctaggctgtttgccttgaacccgaggccttgaaaggcttccaggtggggttgccccgctttcttgatttctcgagccaaatagaaagtctaccatacgcccggacattcgcggtccgtgtgtcgaacctactgcacggcgcgcagcagaccgccgaagccttcgtctttgagaatctgccgatatgggccggcctcatcggcgatgatttgatcgatggcatgcatgccgagtacttcgaccggcgccttgtcgtcggtgagaatagtcgacgctgagtccggttcgttcaccttccggaatcgagaggcgacctcttccatataccattcgagatcttcgctgccggtgcgctcgtaggtggtctcacgcaggttgagcgccttggaggcctgctgcatggagttctcttcggagccggaacccggcttcttggcgaacagttcacggttcgtggtgttcggcacgtcggccgtcagtgtgttcccattgccgaacacgctggcgatggtatcgctcaacgcctcgttgatcgaaccttggccgtccgagatcatgttcatgttcaccaccatcacgccgccggggttcaggtgctctctgaccatggtgaagaactcggtggagctcatctggaagggaatggtgatgtcctgatacgcatcgaccatgatcacgtcgtacttgtcatgcgaggcggcgagccaggctcggccgtcatacgtggtcacggggatgtcggcgggctcatcgaagtattcgccggccagatcggtgatcttctggtcaatctccacgccggtgatgttcattttcggataatactgcttcagctggcgggcgtaggtgccggtgtccatgccgaggatcagcgcggaattggcattgtcggcgagcgccggcgcagccagggccgtgtcgtagtacatacctgtcagtcctttgtctttcatcgtgacggactgcacgccgaacagcacgttggtggacaggatcgtgcggtcggagaggttcttgacctgcaggtagttgtagatggactcgccctcataggccaggttggtttcccagaacgcgaagccggtcaggggcgagacgcaggacgtggccacgaagatcacggcgctgaccacgcaggcgatgcgcttggccttgatcgagatgaagtagatcagcggacatgccggagaagaattcggtgatgtagaggaatatctttgatttgagaatcggccgttcgcttgcctcggtgacctgtgccatcgctccgctcccctgcctgtgcgcctatcgactactgttctgatgcgtagcctatcagcattttcccggccgatgggtggataccggctacagtaggcatcatgactcaggtatgcgtgatttttggtgcgggcgaatactatgcgggcacgcccgtggtgccggccggcgcgtatgtgattgcggccgatggcgggctcgaccatacgcgccagttgggtatcgtgcccgatgtggtggtgggcgacttcgattcgctggagggccggccgccccgcaccgatgtgcgcaccatcgcgctgcccgcgctgaaggacgatccggacatgctctccgcgctgaaggtcggttggtcggcgggttgccgcgaattccatgtctatggcggtttgggcggccgcattgaccatacgatttccggcattcaactgatggcattattggcccggcatggggcaagcgggtatctgtatggtgatgggctcatcgtcacggccatcaccgatggtaggctttcgttccccgcgcatccggtgcccgaggacggccgcatggtgtctgcgttctcccactccgatgtttcgcttggcgtgaacgagccggggctgaaatatgagcttaaagacggcacgctgaccaatacggtggtgcaggggggcagcaacgagttccgcgacggcgtggacgcggccatcagcgtggagcacggcacactgatcgtcaccttccccatcgaggtggcgttgcctcaggtgagtcgattccacgaatttggcggcgatatcggcgagctggacaccgcagtgtccaagctgctggttcgctgacttgcatgccgcgcgcttgctcatgatgattcgagacattcctccaaaggagaggaaaaatcacatgtcggttgcgggcaatccgaattgtgagcgctcacagaaaatacggcatttttgcccaaaacgcacgctgaaacgttgccatgtgtacagagtcggcattacagtagcaactgttggtaaacaatggcccggtgtgccaaagcgcgccaaggccaccctacaagggagaattacatgacagttaagattggtatcaacggcttcggtcgcattggtcgtctcgccttccgtcgcatcttcgagctgcaggctcgcggcggccaggctggtgacattgaagttgccgccatcaacgatctgaccaccccggctaccctggcttacctgctgaagtacgacagcacccacggcaccttccgtcatgacgatggcactccggttgacgtcaaggccaccgaagactccatcatcgtcgacggcaaggaatacaaggtctacgccgagaaggacgccaacaacattccgtgggtcaagaacgacggtgttgagtacgtgctcgagtgcaccggcttctacacctccgccgagaagtcccaggctcacatcaacgctggcgccaagaaggtcctgatctccgccccggccaaggatgacaccaccccgaccgttgtgttcggcgtgaaccacgacatcctcaaggcttccgacgtgatcgtctccgccggttcctgcaccaccaactccatggccgccatggtcaagctgctggacgagaagttcggcatcaaggccggcttcatgaccaccatccacgcctacaccggcacccagatgctgctcgatggcccgcgtggcaccaagaccggccgcaacctgcgcgccgccgccatcaacaccatcgcccactccaccggcgctgccaaggccatcggcaaggtcgttccgtccgtgaacggcaagctgcagggccacgcccagcgcgtccaggttccggacggctccgtcaccgagctgaccaccgttctgaacaccgagaccaccgccgacgagatcaacgccgccttcaaggctgccttctccgacaccgattactacggctacaacgatgagggcatcgtctcctccgacatcctcggcgacacccacggtggcgtgttcgacccgacccagaccgacgtcaacaccattgatggcgtgaccctggctcgcaccgtgtccttctacgacaacgagtacggcttcacctccaacatgatccgtaccctgctgtacttcgctgagatctccgagtgaaccattgcggtctaggccgctacggttcgtttgagaactaagctgtgagacccccgccttgtgcgggggtttcttcgtagtagaacggtaatcatggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggagtgaatccacaggacctgctcaaggtcttgaacgccgttgccgcaccaatcggcacgtggtgaccgttcttggctcccctcacggaggggagccaagaatgactacttcttcctgcgcaactccgccggcagcacaaagtgcatgttttctttgatggtttcgacggacttcataccggtgaaacccaagttttgcagagcgtcaatcacaccggacaccagttcgtccggtacggaggcacccgaggagatacctacggattccagaccctcgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatccgaactcggcggctcttgaatccaagggaatttggccttcagcgcggcaatggtatcggcggtctcgtccacgctcaacgtggtctgcgagagcagcaccagcttggtgtcgggcgcaaaatccagcgaatcgacatccgattcatgctcgatcaagtgcacgtgttcggggctctcccccactacaccgaccgcttcatcgtgacctttatgcccgatatagacgatttcatacccctcgcgcacgaaacgcagcacctcacggtgcaccttacccaccagagggcaggtggcatccaccacatgcatgccacgacgttcggcttccgccttcactaccggagatacgccatgggcggaaaacaccaccggaatacccgcttgggcagcagcatccggaatctccgccaattcctggacgaacaccgcgccttgcccggccaagtcctcgaccacatgcttgttgtgcacgatctgccggcgcacatataccgggggcagcccatcctcgcgcgtccgctttccggaagcctccgcggctttgagaatggtctgtacggtaagaatcgcacggtccacacccgcgcagaagcctcgcggatcagcgagcacaacgcttttggtcatcggaacctcctgaacgtcaatagtgttttccagtgtaaggcagggattacaggaatctgccgtcacaacttttccgcgtctcccacaaatcaccggtttccaaggaatccacgtgcttctcgcatgatggtgtgagactcgtcactccacgtattgctaccgtgtttatacgaattgtttattatatgccgcatatcgccaatccccgcctcgatagaggagacgcgctagactggggccagcgatagcaggagctaccggcccaccaacctcactacgggagtgattccatgacgagtaaaacaccacgcaccggaaatcagtattcgattcactatggcgattattccgccgtcatctgcgaactcggcgccaagattcgccgattcgattatcaaggcaaggaaattttctgcccgttcggcgtcaacgacctgacccccacctgtaacggttatgtgctggccccgtggccaaaccgcatcgaaaacggcgaatacgatttcaatggcaagcattactgcgcgccggttaacgaatatcatcccgcaccgcgcaacaatgcgaaccacggatacgcctaccactacatgtggaagcttgaatcgttgaccgatagcgccgtgacgctttcgctgcgcttccccaacttggacggatacccgttcgatgtgaccgtgaccgtcacctacgaactcggcgacaacggcatgaccgcgaccgtcaatgcccgcaatgatggcgacgaaccggcaccgtgggctctcggcctgcatccgtggctggccaacggcaagcagggcgcaactgccgccgaacgcgatgccgactccgccgcctgccacctgcagattaaggccgccagtcatgtgacggtgaacgaggcgctgattcccaccggcaccgaaccggttaccggtatctacgacctgaacgatggcccgacgctcgaaggccgcgcctttgatgatgcctgggttgacgtggagcgtgccgccgatggtacgaccaccaccacattcacccgcccggacggtatcgaagtgaaaatcattggcgatgagacgattaatgcttggcagtgctacaccgccactggcgcaccgttcgccgagcatccgtatggcatcgccgtcgagccgatgaccgccccggccaatgccttccgcactggtgaccacttggtgacgctcgcccccaacggcgactacaccactgtggtccgctacgaagtagtccagaagtagttctgttacgctggctcccctccagaggggagccaattttttatccttatgtgccgccgcgtcttgggacttatgcgatacgattgtgagcgataacaatttgttccacaaaggagtgtgcactatggctttgaagcctcgcactggtaaccaatatgtcatctcgtccggcgaatggagtgccgtcgtcaccgaactgggtgccagcctgcgcgagctgaagtggcgcggcgaagacctcatcgtccccttcgacccgaacaaggtcattccctgctgcaacggctgggtgctggcaccgtacccgaaccgagtgaccaatggtcagtattctttcgatggcgaagactaccagatgccgatcgacgagttcgaccgccaatcctccctgcacggctatgcctaccgctacatgtgggagctcgttgatttgcaggaatcacacgtgacgctctcctggcgctcccccgacatcgccggctacccgtttgatatcaccatcaccgccacttatgcacttgacgagaacggtctcacggaaaccttcaccgtgcacaacaacgacagcgtgaaggcaccgtgggcatttggcatccacccgtggctggccaacggcaagcacgccaccggtcaggccattatcgccgacaacgagccctgccgtcttgagctgcactgcgacacccacgtgaccgtagacgaacacttgctgcccaccggtgaagagccggtttccggcatcttcgacctgcgcgataaccccacgctggagggacgtggcttcgacgatgcctggaccgatatcaccaaccgcggtgaagacggcagcacttccgccgtgttcacccgccccgacggcatcaaggtcacgctgactggcgacaagaccatcaactcctggcaggtgtgcaccggcaacgaaatcggcgagaaggctcgtcaggccggcgtggccgtcgaaccgatgaccgcctacgccgacgccttccgcaccggcaaggatctggttgtgctcgagccgggcgatgactacaccaccgtggtcaccttccacgccgaacaaatctgaaaaaccgaatagccaagcctgacgctcatcgccacatggacacccgtgttgcatcacgtcgtgctcatgtggcataattccgaaggcttatttttttactgcagcaaaggagtccatcatgggcatgcgcggacgtaagcgcaagaatcgtcgtaagaaggccgccaaccacggcaagcgtcctaacgcctgattcttcgcgtttcttatggaacgctcaaggtccgtctgatgatacatcagacggaccttgttgtatatgtcgttacttatcttcgccgcagcagtgatcaagcgtggccttgagccgggctatcagacattcgggtgccacatccgggcgcaagtaggcacgcaacgcggcaatcaacgcctgttcacgctcgtcgcagcaggtacgggggtcaaaacagtcgccctccgtaacgatatgcacgtccgcctggaccgacgcagaggccgagccggtatccactgaacgatgatgcaccgccgtgatatgcacttcggtctggctgaccatgccatcggcccccgtacgggttatggagatatggcgagtacgctctaccggctgatcgttcatcagatctcctttcccgaaagcttgcttgactgttgtggcgtgcgggcgccagtcgcatgactatgtctcactgcggcttgcgtgtcgccattgctaccaacagtttgttcactacttccattatggccggaatcggcgattcgaccaacgttttcgcccaacttcgcggatggtgaaccagccgacgaaccagaccgtgaaccagccgacgaaccagtcacgtacccgcgctctttcgcatacgaggcgagctcacgcttgagttgcgtgcgggcgcgattcaggcggctcatcaccgtgccgattttcacgccctgctcatcggccacctgctggtaggacttgccgtcgatggcggcgtcgatgaacacctgccggcgttccggcgagagtttggcgagcgcggccatgatttcctcgggcgcgaaggcgtccaaatattcctcttcagcggacttgagcccgtccgacgtatgttcggcggcatcgtaaatgtcccagtcgtcgtattcaccggtggagtcgttggcacgctgcgggcgccgcttggccttggcatactggttgaagtaggcattgcgctcgatggtggtcatccacgcctcgaagttggagcccggctggaatgagtcgaaggccttgaacccgcgttcgaaggtgtcctggaccagatcctgcgcgtcatcgggatcgttggtcagcctcatcgcctgccggtacagtgcattgacggcgggcatggcgagctgttcaaatctggcgcgcttggctgccatggactcgcccgatccggctgactgcccggattgcatagttgcttcgcttgtcgtcacgtttcaccattctaatcaaatcatgtgcccatatcgtggtcgatgacgtgtgagccacaacacgctgcaccccacctgtagaatggcgtatcggctagataatagggagtaacaattatggctttgactttggcttcggccgctgacctgctcaaggaacaccatctgctgcgtgaaatcatccaaggggatgtctggaccgacgacccggcccgtatcgcttcggcggatgagccgttcgccggcatcacctacgacacccgcaaggtcacgccgggcaccctgctgtgctgcaagggccagttcaaggccgaatatctgaacggcatcgacgaagccggcctggccgcatacgtggccgaaaccgagtactcagccgcaaccgccacccccggcctgatcgtcaacgacgcacgtaaggcgatgagcctgctgtccgccgcgttctacggatatccgcagaacgagctcacggtcatcggcgtcaccggcaccaagggcaagacgaccacctcgtacttcacgcaggcgcttatcaacgccgtctccggcggcaaggccgcattgttctcctcggtcgataattgccttgacggccacacctacgtcgaatccgatctgaccacacccgaatcgatggacgccttccgcatgatgcgcgaggcggccgataacggtatgaagtatctggtgatggaggtctcctcccaggcgtacaaggtggaccgcgtctatggcctgactttcgatgtggccgcgttcctcaacatctcccccgaccacatcagcccgatcgaacaccccacgttcgaggattacctgtattgcaagcgccagatcatcgtcaacgcgaagtcgctggtactcggcgcggacagtctgcacgccgatctgttgcgggaggacgcggaggcagccggcatcggcgtgaccaccttcgccctgcatgacgcggataatgccggcaccagtgcggacgtcgtcgcctggcccgccgacccggcgcacgcctccttccacatcgccgacggagatcaggcccttggcgactaccatctgtccatcgatggcgacttcaactacctcaatgcggcggcagccatcgccatcgcccatgcggttggcgtatcgctcgatgacgccgacgcactgcacgccatcgaatccgtacgtatcgccggccgtatggaacagttccgcgacccgcagtcaaacacgctcgccatcgtcgattatgcgcacaactacgcatccgtcaccgcgctgcttgacttcgtctacgagcgttggggcgaggaaaacccgcgtatcacgctggtgaccggatcggccggcaacaaggcctacgatcgtcgtaaggaaatcgtcgaggctgccgagaaccgtatcgcgaacttcattttcaccgccgaagatacggacaccgagccgatcatcgacatctgcatggaaatgcaaggctacatcacgaacaaggatgtggtctccacggtgatttccgaccgtctgacggccatcaccaacgccatttacgatgcccgtgcgcacgccgaccgattcaacatcctgctgatcatcggcaagggcaacgagcgttggatcaaggaccatcgcaagcatgtgccgttcgacggcgacgatcacgtcgtcgaacgcatgtttggcttgtgacgggattccggccaatcaaatcctgatcggatcccgattggcccacatcagatcacgcgcaatacgaccaaaccagaaacacgacatacggatacaaacgaaaaaggatagctgaatcgtaatgatcacgttggagaaagttgacggagccacactggaagccgaagccgagaaggccggcatcacgttgcctatcgaacagaccaaggtttggtctggttttcaggcggatatcgacggacgcacaccatggggcaattatctgatcaagcgtgatggtgaattggtcgccgtgatctcctttatcgattttgagacgcacggttatcattatctgcgctcgatgcatgggccggcgtgggtcgccaagcccaccgaggctgaggagcgcgaggtcgtcgacgccatcgtggacaccgtcaagaaggccgacaagagcatcgcgttcctgcgtatcgacacctggttcgccgatggtacggagaaggtgctgtccacagtgccgtacgaccagaccgtggtcatcgacatcaccggtggcgatgatgagattctggctcggatgaagcgtcgtggacgccgtgacgtgcgcaagtctctacgtgaatgcccggccgaggttgccgatgagacggataaggccctgaccgatttctccgaatattacgatgtgatggtcgaaaccggccagcgcgatggattcacgcctgctccgatgagcgactactccgatatgatcggcgcgttgggtgccgatcattgccgtgtgttcgccgcacgtattgaagaccgtgtggtggcatggtcgattgtcaccgtgaacggcacgcatgcggtgcgctactatgccggcatgcgcaacgaggttatgcgtctgcatgtgaccgacaagctgctgtattccgaatgctgcatcctgggctcgcagggtattacggaatacgatctcatgggcattggctccgacttcgcgccgtctctcaaggggcttaacgagttcaagtgcaagttcaccgaggaaatcaccccggtggcccccgcccgcgacgtacccatcaagaaggtcttctacaagacgctgcagactgtgcagggcgtgcgcaaggcattacgctaataccaccccgctcccgctggtgggagctgtcgagcgaagcgaaactgagggtggtctttcgagatggaccaccctctgtcacctgtggcgccagttcctaccagcaggaaccattcatttatcgttcgagtttttggctcaccacggctgttacgccgtcggctcgcatggttacgccgtagagcgcgtcggcaatcgacatggcgcgttgctggtgagtaataatgatgagctgcgcatgggcgcgtagctcattgaacgcattaatcaaacgggtcaggttcacgtcgtccaacgcggcctcgacctcgtccatcacatagaacgggctggggcgggcggtgaaaatcgcgaacagcaacgccagcgcggtcagtgaacgttcgccgccggacaggaggctcagctgtttgacacgcttgccggccgggctggcctcgaccagtacgccggtggtgagcatgtcttccgggttttccaggcgcagtcgcccggtgccgcctgggaacagcgtggcgaacatctgctcgaatgcctcggcggtatcgtcgaacgcggatttgaatacctggaccatcgtggaatcgagatccttgatgagctgcatcaaatcgtcacgtgatttgaccacatcgttgcgctgatcattgagatacttgttccgctcctcaagcgcttcgaattcctcggtggccaaagggttgatcttgccgagtgcggccagatcgcggcgagccttatcgagacgcttcttctgctcctgacggttatacggcacggtcttaaagcggtcggaatcgccgttggtgccggtctctcccccggtttctccctcttcggtctcagcctcagcttccgtctcatccaacggcacagggttgccctcatcatccagcacgggcaccggctgttcggggccgtaatcactaaccaattcctccaaagtgagaccgagttcgtcggacactttttgcatgagctgcccggattcggcggccaaccgttcgcggtttacatccaaggcatgttcgcgcccggtcagatcggtgaccttgggctcgatctggttgcgctgcgcgcgcagggccttgagttcctcgtcatggctggaggcggcggcctgcagctcgtctcgtttggcggccacgtcatgcagcgtatgctctaccatggcggccactgctcgcgcgtcatcggccacgccttgcaggtgtgcggcctgctcgcgtctgcgatcgttcaacgcctcgatgcgggcgcggcgttcggcggtttctttggcgttgtcccgcagcagcccggcctgtcggctcagtgactcccctttgcggcttgcttcggtccacgcgatttttgcggcgacctcatgctcgcgagtcaggttcagttcgcgctccagcgtgcgttcgcgttcatcgagttcgtcgaaatcggcatgttccgctgtggattgctgggccgatgccaaagcgcgattgaggtcgtcaagcttgagctgatgctcgttgcaattctcttgggtctcggtgattttcctatccagctgctcgagctgacgggtgaacgatgcgacgcgatctgtggcggatttcagagatttctccgcctgctgggctttgagccgggcttcggtgcgtttggcggattcctggtcgacgagtcgagccgcttcatcgcgcttggttttggcctcggccacttgctcagccattccgccgtcttgggcggtcaactgtttgacctgtgccaatgctttgtctcggcgggcggccagagacaggtccgattgagagattgaagagccgccgaccgccgccacgccgtgtgtgaaggtctcgccgttcttggtgacggcccgcatggcttcgccgaatgccacaatctgctgggcttcgtcggcggtgccggccgcggctacatcagccagcaggagacgcacggtgcgcacgaccgcttcggcctgtgccgggttctcggcatccgggttcgcggtgacgagtgctgccagcgcgttgcccgatcgcggggcggcccccgcgttctcggcgctactctcctccgactccgtgcccggctctgtggcgggatcgccggcaatgctcgcggtcagcaccacggctttgccgagcttatcttcccgagcgcgttcgagggcgtgcaacatgttgcctgccgcgggcaccacgatggcgctggcatactggtcgagcgcgtgggccacggcttcttcccagccttcggccacatggatgaagtcggtgagtcggccaagcgaggccacgtccgtatcgcgctccaacgatccggaggcattgcggctgtctagcgtgtcggcaagcgcatcggccttggatttgagcgagatgatcttggactgtatctcgcgctgcttatcggcgcgttcattcagtcgttcgcggcattcggcgagcgttgcacgtgcggcgtccaatgcggcaccgtcatcgtcggcaatggagtccgcttcgctgcgcaatgcgtccagctgttgctgggcatcgtcgcgctgggaagtcagcgagtcgcgttgggaggcgtaatccttggcgcggctggtcgccagttgcacggcggattcctcgcgggcgatgagttcgcgcagtcgggcgatttgcgcatcgcgttcctgtgcggttttgcgcagttccgtcaaggtctgacggactgaagcaagcttcttctcgtcgtcggcgcgttcctcggtggccttgtcgagtgcgatgcgcgcatcggccacggccttggtttgtgccgctgcctgagactccagttcctcggctcgtttgacaagcatgccgggatcctcaccgaagttggtgacgatctggccggcgagtgaccggctgcgctcttcggccaactgggcgagcgcgttcagtcgttcacgggtctgcgagaattcatgccagtattggttggccttggcgatggccggactggattcggagctcaacgcctcgacctgttcgatgcgtactttgacttgggcgagttcacgttgggcgacggccagctggttacgcacagcgccaagctcttgacgtaccgtgtcgcgacggctcatcgagcgttgagcgtcttcggcgtacaggcgggcttgggcgtcgcgtacggatatctgaatcgcgtcggcgcgccgggagatacgtgcctggcgtccgagggggccgagttggcggtgaatctcccccagcaaatcgtcgagtcggctcaggttcgtttcggtattggccagcttgcgcaacgcgcgttccttgcgcttgcggtgcttcaggatgccggcggcctcttcgatgaacgcacggtggccggacgggtcggccttcagaatcgcatccaatcgtccctggcctacgatcacatgcatctgctggccaagaccggtatcggagaggagttcctgaatgtcgagcaggcggcattgcgagccgttgatcgcgtattcggagcctccgttgcggaagatggtgcgggagatggtgacttccgtgtaatcgatatcgagcgtgtgatcggaattatcgatggtcaggctcacctgtgcacggcctaatggcgggcgagaggacgtgcctgcgaaaatcacgtcctccatcgaagtgccgcgcaggtttttggcgccctgctcacccatcacccagatcagggcgtcgacgatgttcgacttgcccgaaccgttggggccgacgaccgccgtgatgccgggctcgaagcgcagcgtggtggcggaggcgaaggatttgaatccgcggagggtgagttccttgagatacatggcgtgagactgttttccgtatgccgggtgtccgggtatccgatatgccttggatgcgggttaccggacgtcggcggaatcgtcggtgtcggcgctggctgtgtcagtgctgtcggtgtcggcactggccgtgccggtgccggcgtcaccggcctgttccttaccgaggccgaggacgtcgaacacgtcgaagtcgtccgggcttaccgaatcctcgaggttgtcggcggcctcatcctcggccttgtctgccggctgatccgaatcgtccgggtcaaccgccggctgatgaacggccatagcctgcctcatcgtggggctggcgtgttcctcaagcatcaggcgtgcgtcgccggcggtgacgaagctgccgcagataagcacgccgtggccgtagcccacgcccagctcgtcctcggcatcgaccatattgacggcggtctgaatcgcgtcaggcaggttcgcttccttgatcacacggtcacgaccgaacacgtccacggcaatcttctcaagctcgtcggccggcatcacgcgctcgcgccacgaattctcggtgaccaccacggagctcaggatcggctccagaacacccagatattcctcgacctgcttgtcgcgcatcatggcgaccacaccgaccagctgcttgaagtcgtagctttcctcgatggccttgcgcagggcttcggcggcattcacgttgtgtccgccatccagaatgatggtcggtgaggtgcggatctgttcgatgcgtccgggaatcttgaccgagctcaacgcctcggccaccaagtcgccgtccagcggaccgttgaccggaatcaccacttcggaggcggcgagcgcggcaagcgcgttgtgggcctgatgctcgccgaacttggcgatcggcacgccctcgtaagtgccgttgggcgtggtcagggtggcgacttggccgccgactgcggccatacggtcggacgcggtcatttcgtagccgtcgcgcacgagcatggcgtggttgcgttcggcggcttcggcgagaatcggcatgacggcttcctcatgcggctgcgggccgatgatggcggtgcagttcggcttgatgatgccggccttctcggtggcgatctgttcgacggtgtcgcccagccactgcatgtggtccatgtccaccgggccgatgatggccgcatccgcgttgagcacgttggtggcgtcccacaggcctcccatgccgacctcgacgatggccacgtccacgggcgtgtcggcgaacttccagatggccatggcggtgagcacctcgaagaagctcatcttcggcttgccttgctcctccatcttggcgtccaccagggccacgagatccttggtctggtcccagatgtcgatgaaatcgtcatcggacagctgctggccgtcgatggcgatacgctcgttgatcttctccagatgcggcgacgtgtacaggccggtgcgcataccgtaggcacggcagatggcctcggccatgcgtgcggtggagcctttgccgttggtgccggtgatatgaatcacgcggaacgactgctccgggtggcccaggatgtcgagcatcaggttcatccggtcgagatccagattggtggtgttatgctccggcgggcggctcatgatgtccagttcgacgtcccgcatgctctcattgttccgattcggatgctcgaatgacatatcctcttctaacctctgctcgtgttgctgttgcgccgttcggagtgcgtatgccacttacgtgttcgcgccattctcgtcatgtctacgcatgcccgcatatattccgcttccgcatgcgcaggaagctccccttgcacaggtttgccccgcatggttcgggattcttgccttcacgcgtggagccgcactccctcaattccctctatcctagccgccggggtggtttatcgtgcgcgcacagtgaaaccgtctcatatgtcgccgccgcgcgggcagtctctacctgcagccacgcacagtgaagccgtctcatatagttgcaatgcggctcttgccgtcggcatctcattcttagtcggctgcaatccaaaacttgtatgtccggcgacgctgatgctattcagcgtcggtacagtgccagcttctggcggtacaccgacgctatgatgctcttgcgagtcggtggctggccaaaacctggattaatcccgactccatcgcctctcagtgtcgtctcctcgccaaggcatgccattctgccgtcgttgagaaatttcaacgtcgtcaatcgaccatgtcttgccccggaaacgactctcacaaacgtcctctacatcatcttttgaactcgcagaggctcattcactgttatgactgctctcaccgtcggcagccgtccaagccctggatctatgccgccaataaattgcagcaaatcgtcggccccgatacaaccattggactcacgccgacgctagattccacactcagacagaagccagccaatatctgaaccagcaccgacggcgtacaaagcataagcaccgttaaccgtcaattcgccgccctctaccagctacatccgccttcgccgatgatatcttgttcgaatccccaaagcacgttgttcgaatgacattactgatggtggataagttttgtgtgttatccactattccgaattagcggcctaataccttgaaattatcgggagtatctcgctccaagacagccaagctccgaggctagaaccacaatggctgaaattcatacttacgctgcttcgttccggctacgctcgacgtcatgaagacacacaaagcagtggcctcgctcatatcagccgcgcagaatgagctgagatgcgtctattcaagaaatgaagcggaacagaccgctctacgccgccgtgcccagagtggtgagttgttgaaagtgtatgacggcattcccagtctttatgcaaatactgcatactgggatggtttgacgccgccggagcgaacgttgcatatggcccgcgctcttgcgcaagagcatcctcagtgggtttttggcggcttggtggcagtaagtgcctatggattcgaacatcaatggcatttgcatgatgactgcataaccatcgtgacttccgatcatggatctcgtcaatgccatcagcgcttacgacatgtctatatgcccgatatgaacaatccgaagacacattacgaggcctccggcctatccctgatatcaccggctagaaccttggtcgaggccgctatagaccttgattttcggtttgcgttaccgatctttgactcggcccttgccaagggaataaccaaggaagagatagccgccgactgcgttcaatggagaatcgattatgcccgagtattccgcctgctgcgctatgcaaacgaaaggagcgagaatggtggagaatccctcgcgcgaggcaccatcatcgaagatcgcttcctcacgccgcgtattcaggtaacggtgaccgacccacagacgaataccgagtaccgcgttgatttcgtatggaagctcgatgacgggcgcgtgatagtggccgaatacgacggcacacaaaaatacgtggacccagccatgaccgataaccgcagcattcaggaggtggtggccaaggaacgcgcacgcgacgagggactgaaacgagccggtgccaccgaaatcgtccatttcacatacgccgacgtcatcgaacgtactccgctgcgggtaaaactgatcaaagccggggtgcctcagatggaggcatccgcagagcagcgggtcccgcgacgcgataaaccttcatcgcatgggttcacatggattcagcccgcaaaatatgccaatatcaatcggcaagctccagcccatgcccctccttccctaccgagaacaataaacgggcccgcattccagcccgatgcactcgccatatgggcatatccggaagaccgtccaaattccgtacttggttttaccgtcagccgtcaatcgtggcacatcgcataaagccgactaatatgaggtgggaatcgatgattcgacaacaactacatacaggagagtggcaatgggtgaagtgatcaccgccaaggacaaggaatatgaggccgaagagcgcgctacggcaccgggcgcgaaccagtcgatgagcgaccgcgtgaacaaccgctcgctgcgcccgcagtcggccgcattcaaggagttcatgaagtccggctgggccgacgacgatccggagatcaagcctctcgaatcctccaagttcacgccagcccgccttgaggcgctgggcaaggccttcccgggcgaacgtctggtcattccggccggccagccgaaggtgcgcaacaatgattgcgattacatgttccgcccggacaccacgttcgcctactacaccggtctgggttccgattacgaggccggcgccgtgctggtcctgaacccggtcgaccccgactcccccgaagccgccgccggcaagacgcacactccggaactgttcgtggcacctcgcgccgacaactccaccgaggacttcttcatgtccgcccactacggcgaatactgggttggcccgcgtgccggtctcaaggagatgcaggcgatgaccggcatcgaaacccacgacatcgcccagctggccgacgccctgtccaaggacgtgggtgccgaagccggcgccgtacgcgtgcgcgtggtcagcgaaaccgacccgcaaatcacctcgatggtcgagtccatccgcgaggccaacggtttcgccgatccggacaagaactccgcatccgacgacaagctgcacgagttcgccgccgaggcacgcatggtcaaagacggctacgaaatcaacgagatgcgcaaggccgtggacgccaccaagcacggcttcgaccgtctgctctccgcactgccggccgcgctcgacaagccgcgttccgagcgtatcctcgaaggcgcgttcaacgccgtgtcccgtgaactgggcaacgccatcggttacgactccatcgtggcctccggcccccacgccccgattctgcactggatgcgcaacaccggtgtggtgaagaccggcgacatgctgctggtggatgccggcgttgaggtcgattccctgtacacggccgacatcacccgcaccttcccgaccaacggcaagttcaccgacttccagaagcgtctgtaccaggccgtgctcgactcgcagcaggccggtttcgaagccgccaagccgggtgccacctattccgacatccaccacgcctgcatgcgtgtgatcgccgagcgtctgcacgattggggtctgctgccggtgagcgtcgaggagtcactgtccccgcaaggccagcagcaccgccgttggctcgcctgcggcgtggcccaccacctaggtcttgatgtgcatgattgcgcgcaagcccgctatgagtcctatcagggcgcgaagatcacgcccggcatgatcttcaccatcgagcccggcctgtacttccgcgaggatgatctgctgattccaccggaataccgcggcatcggcatccgcatcgaggacgacgtgctcatgaccgagaacggccccgaatggatttccgccggcatcccgaagcagatcgacgacgtcgaagcctggatggccgagcaggctgcccaagcgaagtaacctaagctccctctgatgagggagcttcttttctactaaggaggcaatgtgtccactccggaatttgtgttggaattgcgtaagaagatcggccatgatctgttgtggctcaatggcgtgaccggttgtgtactgaacgaacatggtcaactgctgttgggccgtcgttcggacacgggcgaatgggcgatggtctatggcatcaacgagccgggcgaacagccggcggacacggtggtgcgcgaaatcaaggaggagacgggcatcgatgccatcgtcaccgatttggtggccgtcacctcgtcaaacaaggtactgacctacgccaatggcgacaacaccatgtacatggatcattcgttcctgtgcgccctgaagcccggcggcaatgccgagccgttcgtaggcgacgaggaaagcctgagcgtcggctggttcgatctggatgacctgcccactcccctggcggccagcacgagcgagcggctggagctgttccatacttacatcgagaacaaaaaacacggcgacgcccacgccctgttccagttcgatgggcagcagtactagcggatataaagttagctccctctgacgagggagctccaatgctatgcgattacgcctcttgggctaggagctcgtggaggtgggcgcggtgttgctgctgttcgcgcgggtcgggcacgggcagggaggccagcagcttcttggtgtacgggttctccgggtgctgcataatctggtcggcatcgccgtgctccacgatctggcccttatgcatcaccatgatgcggtcggcaagcatatcgaccaccgccaaatcatgggtgatgaacaggcacgcgaagccgatttccgcctgcagtcgcttgaacagctccaacaccttggcctgcaccgacacgtccaatgcagaagtcggctcatcggcgatcagcagcgacggcttcaacgccaaaccacgcgccaaagacgccctctggcgctggccgccggacagctcatgcgggaaacggttcatgtaggcgcgcggcagctggaccatctccagcagatcgcccacatagttcttggcatcggccacggaaccgtacttgtggtgcacgagcagcggctcggccacattctccgcgatggtcatcagcgggttgaacgaggagcccggatcctggaacacgaaaccaatgtccgcgcgcttgggcttgaagtcacgctccttgacgccgttcatctcgatgccgagcacgttcagggagccgccggacaccttctgcaggccggcgatggcacggccggtggtggacttgccggaaccggactcgcccaccaggcccagcacttcggagcggtggatggtgaagttcgcgccgtccacggccttgaagtcgggctgcatgagatggcccgggtacgtgatggtcaggttcttggcctcgacggcaatcggctgttcgcgccaatcggccttgcgctcgatcggtttgccctcgcggtcgcgcacgaccagcttctgaccgatgcgcggcacggcacccagcagtcgcttggtgtagtcgtccttcggatggtagaagatctgctccacgtcgccctgctcgaccacgtggccgcggtacatgacgaccacctggtcggcgatgtccgcgatcacgcccatgttgtgggtgatgatgagcacggaggcgtcgaactcgtcacgggcgaggcgcagcaggtcgagaatttcggcttgcacggtcacgtcgagggcagtggtaggctcgtcggccagaatcagacctgggttcagcaccaacgccatggcgatgacgatgcgctgcttctggccgccggagaactggtgcgggtagtagtccacgcgggtttcggcatccgggatgccgaccttcttcaggatgttgatggccttggcgcgcagttccttcttgtccttcatgccgtgggcgcgcaggccctcttcaatctgccagccgatggtgtacaccgggttcagcaccgaattgggctcctggaacaccatcgcggcctcggaaccacgcacttcgcgcagctgttcgccgctcagggagagcacgtccagcgaatcggaaccatcgcgcttggacaggtagacggcaccggaggtggtggccgtctccggcagcagcttgatgatggagcgcgcggtcacggacttgccggaaccggattcgccgaccacgccgaccacggtcttgcgcggaatggtgaagttcacgtcctcgacggccttgatggagccggcgtcggtcatgaaggagacggacaggtccttgatatcggcgagattcttgttgttttcgctcatctctcactccttgccttccggcttgccctcgccggtccattcggaggcgacgatggtcgggtcatggtcggtgacggtggccggcgggtcgacgttcgcgtcgagttcggcgatcacctcgttgcgtgcggtcggcttctcgtttgggtcgacggacgtgtcttcgatcgatccgaccacttcgccggcggacttgcgggcgcgcagacgcgggtcggccagatcgttgagcgattcgcccacgagcgtgatgccgagcacgatgagcacgatggcgatgcccgggaacacggcagtccaccagatgccggcggtcacgtcggaaaccgaacggttcaggtcgtagccccattcggcggcggcggtcggctcgatgccgaagccgaggaagcccaggccggcgagggtcaggatggcttcggacgagttcagcgtcaggatcaccggcaacgtgcgggtggagttcttgaacaggtgcttggtcatgatgcgccaggtggaggcgccgaccacgcgcgcggactcgacatacgcggattccttgatgcggatcacttcggcgcgaattgtgcggaaatactgcgggatgtacaccacggtgatggagatgccggaagccagaatgccgctccacaggccggactggccgtgggagatcatgatggccatcagaatggcgagcagcagcgaggggaaggagtagacggcgtcggcgatcatcaccagaatgcggtccacccagccaccgtagtagccggagaccaggccgagcagcacgccggcgaagatggagagcagcacggccacgacgatggcgatgacggcggtgcgtgcgccccacaccacacgggagaacacgtcgaatccggcggcggtggtgccccagatgtgttcggcggagggtgcggcctgcgccgggaaggacgtgccgtcggcggccttgatctgggcgtggccgtagggggcgatcagcggggcgaagagggccacgagcaggaagaacgcggtgatcgcgagaccggtgatcagcatgcccttctgccagccgaccgccacgcgcagttccttgatgatcgggatcttggtccagaacggcgtcttggtgctgacgttgagcttggtaaggcggtcgtcaccggggacggtgatcttgtcttgggatgcggtggtcatctcagtacctcactctcgggtcgataagcgcggcgatgacgtcgacgaggaagttgacgacggccacgatgatggcgataaggatcacgatgccctgcacggccacgaagtcacgggccttcaggtactgggacagcatgaagcccagtcccttccattcgaaggtggtttcggtcaggaccgcgccggcgagcatcagggcgatctgcatgcccatgacggtgatgatcgggatcagggccggccgccaggcgtgcttgttgagcaggcgcttttcggagacgccgcgcgagcgggcggcctcgacgtagccggaattgtaggtggagatgacgttggtgcgtaccagacggatgaacacgccggcggtcaggaggcctagggcgacggccggcagcacggcgtggcgcagcacgtcgacgagcacgttcatgtcgccgagctggatggcgtcgatgatgtagaagccagtcggcgataccagacgggtgaactgcatttcggagttcaggtcggagcggccggaggctggaaggatgttgagccagacagcgaagatgagcttcagcacgaggccgaggaagaacaccggggtggcgtagcacaggatggcgaaggtgcggatgccggcgtcggcggcacggtcgcgtttgcgggcggcgagtcggcctaggccgatgccgacaatcagcgccacaatcagggcgaggaaggccagttcgaatgtggcggcgccgtagtgcgtaagaatgctgatcaccggctggttatcggtcagcgtcgtgccgaggtcgccgtgcagcaggccgccaagatagtcgacgtattgcacaatcagcgggcggtcatagccggccgcgtggatgcgctgctggagttcggcgggtgtcaggcggccgcccaaggcggcggaaatcgggtcgccggtggcgcgcatcacgaagaacacgatggtgaccagaatgaaaacggtgggaataatgagaaggaacctcgtcagcacgaagcggaagaaactacctgacagtcggttcttcttcgtcttggctttcgccggagtggtgctggaggtcgctatggcgctgtctgacacgcgatgctccttggtgttggtaatcggtatataaagcaataaaggctcccctctccgaggggagctggcggcgaagccgactgaggggagtcatacgagttgggctcccctcagtctgccgtcggcagacagctcccccccctcaaagaggggagctcatgctggatcagcccttggtgacggaggcatagcggaagcggaaggaagcgtcgagggtgacacccttcacggaggtgccggtgacggcgacctgggcaccctgcagcagcgggatggtggagaggtcttcggtctcgagcttctgaatctgcttgaggatgtctccacgagcggactcgtccttctcgccggcctgcttgacgatcaggtcgttgacttccttgttggagtagccgttgttcacgaagttaccatcgcggaagaacggggacaggtagttgtccgggtcggagtagtccgggaaccatccaagctggtagaccgggtacacaccgtcggaatcgtcggtaaccacacgatccttgttgtactgggtccattcggtggactgcatgtcgaccttgaacaggccgcctgcctcaagctgggacttcagggcagcgtactcgtcggcggagacggagccgtagtggtcgctgttgtactggagcttgaggtcgaccggggtggtgacgccggcgtcggcgaggaccttcttggccttctcggtgctcggcttgccgttgccgtcgccgtaggcggacttcagcgtgtcatcgtgaccggccaggccgtccgggatgaaggagtacatcggggtgtaggtgcccttgtagaccttggtggagagctcttcgcggtcgatgaggttggcgacggcctggcgcacggccttggccttgttggcgtcggcgtcgggctgggattcgccgtagggctgaatcttgaagttgaaggcgatgaagcgctcctcaccgcccgggcccttgacgaccttgaccttggagtccttggagaggtcctcgatgtcggtcgggctcagggagcggttggccacgtcgatctggccctgctggacggccatcttcaggttggaggcgtcggcgaagtacttgacctgcacggcggagttcttggccggggtcaggcccttgtaggagtcgttcttggcgtaggcggcggactcgttgatcttgaaggcggtcagcgtgtacgggccggcaaaggccttcttggagacgatggtgtcggcgtcggtgagcttgtcggcgtcgaaggtatcctcatcgacgatcgggccggcggggctggacatgacctgcttcagagtcacgtcaaaaggcacggaatccttgaacaccacggtggtgtcgtccttggcggtcacggattcgacgttggcgagcagggagctcgggccgttcgggtcgttgatcttcttgatgcgatcgtaggagaacttgacgtcggaagcggtcaggtcgttgccgttggcaaacttcaggccgtccttgagcttgacggtgaattcggtgccgtcatcgttccaggtaccgtcatcggcggcgatgtccgggctcagttcggaggtgttgtagtcctgggcgtacaggaacgggaacacctgaatctgcacggcgtatgaaccgttgtcgtaggagccggcggggtccaggctggtgatcttatcggtggtgccgatggtgatggcgttgccggaatcggcgcctgcggcggtgtcatccttcacaccgccgcaggcggtcagggatgcgatggcggccacggagacggcggcggccagaatcttcttggaattcaacaggaatcctctctcataacttgtttccacgtcatcactgcgggcgtggattaccgcctgactatggtgcggatgtgttacctctgcgtttccatagtcatcgacttatgtttcgcttgtggcgaccaaggccggttttatgcggtatcgagcagtattacggattcttgtattacgacgtgaataacggtcacatggtgagacaaatatactatcatctcaccatgtgaccatgttcgtagacgaatgccttccattcgtcaaccggtcggcctactgctacttgagcttgcggcccgcgcaccacacctgttcgaccgtccagtcggccgggtccgcaaggttgaaatcggcggcgaagccgggggcgatgaggccgatcggcgccccggtgaccgggttcggccggtcgaagccgaacgccttggccggcgtcagagttgccgcctcgaccgcgtccaccgggctgaagcccagttcgcacaccgcacggcgcacggcgacctccagcagcagagtggagccggcgatggcgccgttggagaccaggcgcgcatgcccgccgaccacgttcacgtccagcgcgcccaacttgtaggcgccgtccgggcagtcggtggcggccatcgcgtcggtcacgaaggccgtgcggtgaggcgcgaaccggaaggagaggctcaccatcggatcctgcacgtggaatccgtcgttgatgagctcgatggtgacgcgcgggtcctccaccgcggccggaatcggaccgggttcgcggtgatgcaggccgttcatcgcgttgaacatgtgggtcatgatgcccgcgcccgcgtcgaagccggctttggcggtctcgtagtcggcgtcgcagtggcccacggccggcaccacgccggcagcggcgaactggcggatggcggagatgccgtggggcagttcgggggcgatggtgatctggcggatgcagccaagcttgccggaggcggggtcggcaccggaggcctcaagcatcttatcgacgatgtcaggcaccggatccttgagacattccgggtcatgtgcgcccttgcgggccagggccaggaacgggccttccagatggcagcctaggatgtcggggcggccggactccatcttggcgcggacggtgcggatgttgcggcagatcacgtccacggggttggtgatcagcgagagcacctggcgcgtggtgccgtgcacggcgtggccggcccgcgccacgtcgatgccgtccggcccgtcatcgaagctcttctcccatgcgccgtgcgcgtggatgtccacgtagccgggggtcagaatacggccttcggcgtcgatgaccgcgttgcgatcggccgggtcgagccccaccgtgcggcagcagtgctcgaaggtctcctcccccgtgccggccgccacgatgacgccggcggcatcggagacgacccaatatccgcgccgttcaccgcgcgcatccaccttgcgcgcgttacgaatcgccaccggagccggcttgccctccagtgccgcggtcacgcgcgagactatctcgttcctatcagacatgttgttctccttaccgctcatgcgctcccgctggcgggagccagcacacgataactcagatgccctgccaggccggcttgtgggtgtaggcgtaacggtagtagtccttgtggcgcaggcgggacgcggcctcctcatccacgataatcgtggcgtgcgggtgcatctgcagcgcggaagccgggcagaacgctgacacgccgccttccaccgtctcctcgatggcttcggccttgccggcaccgaacgccagcagcacgaggtgacgggccttcatgatcgtgccaataccctgcgtgatgcagtgggtgggcacttggttgatgtcgttgtcgaagaagcgcgcgttgtcgatgcgggtctgttcggccaaggtcttgacgcgagtgccggaggccagcgaggaaccgggctcgttgaagccgacgtggccgtcggtgccgatgccgaggatctgcacgtcgatgccgccagcggcttcgatggcacgatcataggccgggccggccagcgcgactttgtcgccgtcttcgagcggagtgccgttgagtacgtcgccgggcacatggaccttggccgggtccaggccaagcggttcgaccacggtgcgatggatggtcgcatgataggactcgggatgggtcagcggcagcccgatgtattcgtcaagcgcgaaaccacgcacgcccgaaacgtcaatggcctcgtccttgacgatcttggcgagcgcctgataggcggccagcgggctggagccagtggccaggcccagcacggcgtccggctttgctttgatcaggtccgccacgcaacggccgtagatctcgccggcctcggcttcgttcttgacaatgatgatttccggcatcggtttcctccagttccgtgcggcccgcccgatgcgagtcgctgtaccgccgcccgtcttgcggataatggcaacatccttgtcacgtccgggtgccgcgcggcgttccaaccaccgttcggcgtagcgccgattggtgattcgctatttgttaatgatactaacaattttggaccttatgaacactcacggtgtttcctgacgcttcacacaggtacactggaatttattagtgaagtttcataacagtttcaacgacgaaattgcgcttcaccgtctaagctgtgtatggaacaacaatcgccgtccactcgctcaccatcaggcaggaggaaacatgtcatatctcggtctcaacacaacgaccgacgaccatgcggccaaggcttcccccgccgatgtgcgccgcaagaaccgccaacttatcttcaggttgttgttccccaccaaccagtattcgcgcgccgagctcggccgacgcaccggattgagccgcgtggccgtttccgatgtggtcggtcggatgctggaggaaggattgctgcgcgagaccggtcaggcacccagcggcggcaaaggcaaacgaggcacactgctgagcatcgatatcgatcgactgcgcatcatcagcatcgacctgacgcaggagcacctgctgcacggcgcagtcaccaatctgctcggccagccgctgcgtcacgccgaagtcaccctgaacaccggctcattcgtttccgtggatgtgatcatcgagctcattgagaagatgctgggcatgtccgatggcgaggtcatcggcatcggagtcgcctcccccggcgtggtagacaacggcgtggtccgctcctccacgatgcgcggctggaacaatctcgacctgtccacgccaatcgccgaacatttcggacttgaagtaaacgtcagcaacgacgccaccgcagccatgctcaccgaacgtttctttggccaaggcgggccgaatatgcttttcgtgcgcatcgaaagaggcatcggttcggcgattctgctctcggacacgccggtaatcggcgaactgcacgcggctggcgagctcggccatatttccatcgatcttgacgggccgctgtgcccttgcggcaagcacggttgcttggagacgatgatttccggaaccgcattgaagaagcaactcagcgcagcagacgtggagcagcatcagggtatccttgctcgggcgggccgctatcttggccaagccctggccatgcctgtgggccttttggatatggcagacgtatgcgtctatggccagccgaacatcatcaacgcgacgttcatcggcgcggcccagcaatatctggatgccgccacatcctcgtccttccacaaacacacggtgattcggcgctgcgaatgcggacctgacatcaccgtacagggcgaggccatcgccgtggtcttccaacacttggccaaataaaagccggtcaccccggcaacgaaacgcgcaagaccaagcgcggcacagcacgacataaagcgatataggactgcgtgggagatggggcctcggagacaaatctgaggcctcatcccccatgccccggcactatgccaggctacgccgccatggcggcaccgatggctccgactggttggccgacaggtgccagacgcagccgggccggcaggtccagcgtttcgaggaatcggcattgcgattcgcgccggcgcagctcagccgtgatcacctcgaccaatggttcgccggttttggccatgccaccgcccaagatgatgagtcgcggatcaacggactgagccaggatttgtatggtgtcgccgatggcgcgcactaccatgtccagcacatcgacggccttggcctcccgctttttcgcgcgacgaatcaggtcgggcatcggcgggtcggcgttgggccacagacgccccacggatgcgcccgagcagactgtttccaagcatccgtattgcccgcaagggcacttgaggcgatgaggttcgactgggatatggccgatttcgccggccgcgccgctatagccatgcatcagcacgccgttttcgacgatgcccgcagccagtccggtgccgaagttcaggaacgcaatggtaccggccatgccgtccgcaccgcccaatacggtggccgcgccgacggcggcggcattgacgtcgttttccacatgggccggcacgcccgaacgctgcgagaccaacggccccatatccagcgagaccacgtcgagattcacgatattgcccacatgcccgctggccgaatccaccgtgcccggggtaccgacaccgatggccctcacctcgtcaaaacgctcacccgctgcctgatgtgctacagcgacgatgtcttcgatcacggcatcgttgccatgcctggcgggaatacgggcggaacccaataccgtgcccattgcgtcaaccagcacagcttcgatttttgttccgcccacgtcaacaccgattttgagattgttcatagtgttttcagacatcagtcctcccctgttcttcatcgaacgtttcgcttgatatcagtgtacatccgactattgacaaccatcttaacaaattcccccaagacgacactcacatgcacgacacgccgaatgacatattgattgcgtcaatcaattaacagcgttaatatcttaatcaagttcagattcaaagacgagcggaacaactcgcagcggtgcagacaaggaggacttaagaccgatggcaacaaacaccacccacgccacttcccaggccagtgtctccgaatccaaccgctcccgcatcgtcaagcacctgtatcacaacggcatcagttcccgcgcgcaaatcgccaaggcactggaactcacccccgcggccatcaccaaaatcaccgcacgccttatcgaggccggcatgattgaagagaccggcgatctggaaggctccaagaaccgccgttccatcggactcaagctcaacaccacgcacttccgcatcatcggcatcaaattcgcccgctcgctggtgcagatcggcgtgttcgacctgtgcggcaacaccctgagctttgaaaacctgcccacggtgtgcgacaacaccatcaacgactccatcgtcaccatccaccagcgcgtcgaacaactgctcgacaacgacccgtccatcgtggccatcggcatggcagtgcccggcccctatctgcgtaacgtgggccgcaccgccgtggtgtccagcatgcagggctggcgcagaatcaacttcatcgacgaattcgccaccgctttccgcgtgccagtgttcatcgaacaggacgcccgcgccggcgccctcgcacattatctcttcgacccgtcggtgcacgccgacgacaacctcgcctattatctggtcggcgaaggcgtgggcctcggcgtcatcgacaacggtcgcctcatcaacggcttcctcggtgccgccaccgaaatcggacacatctccattgacgtcaacggccgcccctgcgattgcggcaacgtcggctgccttgaacgctactgctccacccccgccattcacgatacgctcatcgccgatggcaccgtggttcccggcgcggccgatatgacccacaccgaagccgcccgcgccctgttcgccaaagccggcgacggcgacgaagcggcaatcgccattgtccgcgaagtcgcccgatacgtcggctacggatgcgtcaccatcttcaatggatacaatcccgagcacatcatcatcggcgacatcgtgtccgaagccggcccgatactgctcgatgaggtgcgcgccacggtggccgaacgggccatccccgaaatcaatgcctccacttccatcagcctatccaccttgtccgccgacgcggcggtctccggtgccgcagcagtggcagtgacccaattcctcgaacacccctcggtgttcttcgacgtctcctaaaccaagcgccgacatcacaagattttccatacgaaacacccgataaaggaaacaaaggaaaggaaaccaaccatgactaccccgatcgttctgagcctcggtgaactgctgtgggacatgctgccgagcggcaagcgagccggcggcgcccccgtcaacttcgcctaccacgcgatgaagaacggcaccgaaggctgggccatcagcgcggtcggcgaggatgaactcggcgacgaactgattgccaaggccaacgaggccggtatcaacaccgtcatccagcgcaatgcctggccgacctccaccgtcgaggtcgcactgaagaacggcatcccggagtacaccatcgtcaagggcgtggcttgggaccacatcctgtacacccgccagctcatcgacgtggtctccaaggccgacgccgtctgcttcggcaccctggccctgcgctcccccgaatcgcacgccaccatcacggagctgctcaagcacaccaagccgggcgcgatgaagttcttcgacatcaacctgcgcggcgaccactactccaaggaacttatcgaggaactcctcaaggcggccaccgtcttcaagatcaacgacgaggaactcctgctgctgcgcgacatgttcgacatccgcggcacctccggcgaagatgcctcccgctggttcatcgaggaattcggccttgactacgtgattctgaccgccggctccgcctactccaccatcatctcccgcaagggcgaggtctccacgctggacactccgcacgtcgaggtgaacgacaccgtgggtgcaggtgactccttctccggcaccttcaccgcccgcatcctgctgggcgacacgctcgccgaagcccaccgcaaggccgtcaacaccgccgcctacgtctgcacccaggccggtgcctggccgcagtacccggccgagatgcccgactacctggctgaaatcggcaagtaatccaaaaccacctattttcccgatggctttgccgtcctataccggcaaagccatcctgttttaaaaaggagttaccatgtccattcgcgacaccgtcaccggcgtccagcatgtcggcattccgaccacggatctcgaaggcaccatcgcctactacgagcgtctcggcttcgaatgcctcggcatctatcccaacggcgaggaccgctgcaccttcctgcgcctgaacaacctgaccctcgaggtgtggaccatggatcccaccccgatggaaaacggtgccatcaaccacttcgcgctggattccacggatatcgaggcgtccttcgctgaagcgcagaagctcggcctgaacttcgcggaaggctccatccagcacatcgacaccttctggagcaacggcatccgttacttcaacgtactgggcccgaaccacgaggtcatcgaattctgccaaatcatgtaacaccctgatggaacccggcaacaggactatcactattcactagtcatcatccattgatcgatcgatctgtcatacgtccatttatagagaaaaaagggaatacatatcatggacaagaccgcatccaagaacgtggcgtgggtggaaagccctgacggctaccttgatcgcacgccagtattgcaattttcaatgacttcggtgctgttcgccttctaggccatcgccgcaagcctcaatgacattcttatcacccagttcaaggccgtattcgacctgagcgacatgaagaccgcgttcgtgcagtccgcattctatgccggctacttcatcgtggccatccccgcctcgctgttcatcaagaagaccagctacaaaatcggcatcatgaccggcctggcgttcttcgcgctcggctgcttcatcttcttcgtggaccgtatctccgccagctacctgctctcgaaggtccgcgagactcgcgtgctgaccgtctacatgattatcggctgcgtgattcttctcggcaccgccttcatcctgccccgccatcgagctgttggtcgtcggcctgtacttcctgactgaattcaagcgcgacacgtacaccccgccccagctcaaggccatggacgagaagaacgaggcctgattccgccccctttgttcgtcattcgtgtgacttcacgaatcgactgaccgcaaccggtgagattctccgaacaggaaatctcaccggttttttcatatggtgtactcacggccacgctcttcacatcctttcgcgtgtcttcaactaaagcggtttagaataatgctgttcccttgatatgtatatccctcaaacaaagaagttgaatttatgacgaccaccgcgataccgaagtcggtctcggatttcttgcagcgcatcacggacctatgtggcaccgaacacgctgattgggccgagaacttcaacgcctgctttgccgataccctgaccaccacggtcaaacggcatgacgacggcaccacatttctgctcaccggcgatatcccggccatgtggctgcgtgattcgaccgcgcaattacgcccttacctagcccttgccgccaaagacgacgacattgcgaacttgatcgccggtctggttcgccagcagttccgctacattaccatcgacccgtatgcgaacgccttcaacgaggaaccgaacggtgcctcctgggacaaggacgatcagtccgacttctccagcccttggctttgggagcgcaagtacgaggtggattcgctgtgctaccccatccagttggcttggatgctgtatgcgaacaccggcaacaccggtcatttcgatgccgaattcattgccggcgtcaagaagattcttgacgtattcgagaccgagcagcatcatgaacgctccccgtatttcttcatccgcgacacggacatccccaccgaatcgctgagcaataacggcaaggggtcgccggtggcgtacaccggcatgacctggtccggcttccgccccagcgacgacgcctgcacctaccactatctggtgccctcgaacatgttcgccgccgtggtgatgggctatctggaacgcatcttcggcggtgagattctgaatgatgccgatatcgccgcccgtgccggcgagttgcgccgcaccatcaccgaaggcattgaagcccacgccaaaacgacgaaccgcaatggagagacgatctacgcattcgagaccgacggcctgggccacgtcaatatcatggacgacagcaatgtgccctccttgatggcggccccttacttgggatactgcgcaccggacgatccgacatatctggcaacccgacgtacgctgctcagcaacgaaaacccgtactactacgagggcgagtatctcaagggcatcggctcaccgcacaccccgccgcgctatgtgtggcccatcgccctgtctatcgaggcgatgaccagtgacaacaaggacttcaaggcgcatatcctcgaccgtcttgtagccaccgacgccggtacacatctcatgcacgaaggcatcgacgtgaacgatccgaccaagtacacgcgcgaatggttcagctggtcgaatatgatgttctgcgaactggtcatggactatttcgacattcgcgtgaaacactaagacgtgcccgctgaatgctcattgtgcacccaccgcatgttctcgttaaggaaaggaacaatcattatgaccaataacccacgttatacgctcggcaccgaagccaaccgcattttcatggcttccgaaacctacgagctgctgaagttcggcaaaggcttcccagcaccgaacggcggttccggctggctgaacgccgacggcaccctcgacccctcccacggcgtcgaaacgtggatcaccagccgtatggcccatgtgtattcgattggtgccatgctcggatacctgggtgcgggcgagctggccgacgcggcgctcaagggattgaccggcattctgcatgacgacgagcacggcggctggtatccgcaggtgttcgcggacggcacccatgcgccgggcaaggtctgctatgcgcatgccttcgtgattctcgccgcgtcctccgccctgctggccgggcgtccgggtgccaaggaactgcttgacgaggcacttgccacgtatgacaagcatttctggaatgacgaaatcggtttggccgtcgatacctggaacaccgaattcaccgagctcgacccgtatcgcggtctcaacgccaacatgcacaccaccgaggcattcctagccgtggcggatgccacaggagacaacgcctatcgagtacgcgccggacgcatcatcgatcatgtgatcggctgggcgaagcacaacgagtggcgcatccccgaacatttcaagtccgattggtcgctggacctcgaatgcaacgtcgacaagaaggatgatcagttcaagccgtacggcgccacgccgggtcacggcatcgaatgggcccgcctgatcacgcagtgggcgttgagctcctttgccaaccttgacggagcacagccgtacgtcgacgccgccgaacacctgttcgcgcgtgccgtggccgacgcatggaacgccgacggcaccgtgggactcgcctacacgaccgactggaacggcaagcccgtggtcaccgatcgcatgcattggacgctggccgaatcgttgaacacttccgccacgctgtacgcggccaccggcgaggagatgtacgccaactggtatgccacgttcgcccagtatgtcgacgaacatgtcatcgaccacgagagcggctcctggttccaccagctcgacaagaacaaccacgtgatcggcacggtctggccgggcaagtccgacctgtaccacgccttccagtccacgctgattccgttcctcgacccggccgtgtccatcgccaccgcggtcaagaacgcggcctgaccggcaatatcttagccttcttatctcctccttcaacgacgttggccccccgcttgataacgagggccaacgtcgtatggattggaagtgctgactcagaatcggtggtttctatattccacaggagttacagggtttggccgtgctgtccctgaccaccagtttcggggtgaggattcgacggttgccgctcacctgttcgccggcgagcactttgagcagcagtttcgccactttggcaccgtattcactggcgtcacgatgcgctgaggtaatcgacgggtacgctgcctcacaaataaagctgtcttcaaagctgacaatagcgggcaacccgttcggataacccgcagattgcccctcccctgttttcagttgcccggtggtatatgcttcggccatggcatgcagactggccgcggcaagaatttccgtctcgtagacgaatgcagtaggaggcttcggcgaacgcaacatctccagcgtaagcatcgcggcctgctcggcatcgaaattcgtgaactcgatgttgatggattccagtttgcgccgttttgcgaacgaccgaaacgccgacacacgcccctgcgaataatcgagattggaatcgccggacagataggcgatacggcggtgccccagtgacgacagatgttcaagcacggtgcccatggtgcgcgaatcatcgatggacagcgacggtacataattgttcggatcagggccaccggccagaaccgcacgcacacccagttccttcagcagtttcgggcgtggatcgtcggctcgcagatcaaccagaatcaccccgtccacacgcttgcgtgacgcccagtccctgtagacgctcatctcctcgttcagcgaacggcaagggcgatacagcaagccgtatcccttagggctgagcgaggtatgcacaccggccatgaagtgcaacatgaaggtttcgtccgtgagtccctgtgcggagcgtgcgggggcaaagcctatggtcatggttttcgacgagcccaacgcttgcgcggcatagaccggcgtccacccaagtttggccgcagcctccttgactcgtcgtttggtttccgcggaaacaccaggccgatcgttgatggcaaaggacaccgcggtttgcgaaatgcccaactcatccgcgatgtcttttaagctcacacgctgcgtgcctgtgtacgatggtgatgcctcgcgagcaaatcccatgaataatcctccttgcagccacgctgcgaataccacgctacaacagattatttcccactttgggccgcatgtaatcagctgtgttctaatacctatgatatcaacaactaaaacgttttagtctatgggtctcagcatatgttcggatataaaaagcgggatatagggggtgtctacagggacaaccaccccatatcccgcttaaggcacgggtatcaacgcacccacatacgcagcgaaactattccatcttgctacgagcacgaagcaccaccgtgcccgctccgagcaacaccactgcggcagtcacaatcgcaataatcgaagagcccgtcttactcagcgaagagtccgatgcgccattcttatcattgttcttgttgttgttctggccaggcttgttgtcgccgggcttattcggcttgtccggctggccgggcttgttcggggtcgccgcgaccttggtgaattcgatggcgacaccctcaccgatggacttgtcgcccagtgcggccttcaccgtgtacttgcccaccttcgtggacacgacgttcagtgaagccacgccagcggcatcagtcttgacagtggcgttgccgtcaacggccgtgacaccctcgggcagcgtaaacgccacctcggcgttggtcagcggattgccgaacgaatccttgaccgttgcctgaatcgtacgtgtagccttgccgtcggccacggccgagccgtcaacggcggtcagcgtggactccttggcatccggctgagtcgggtcagagaccgtgcacttggccagttcgtcggcggtctgaatcttcaccggttcggtcttgttgccgttgtaatcctcgacctgcacccacagttcatggccagaggggatggacttggtgtaagagctcggcgtagtgcgaccacggatgatgccggtgattggcggagtgctctgcgagtaggtgtaattggcacccagctgcttctcctgcttttcaccgttctcgtcagtccacttctcggtcatgtagaggtagcgccagtcttgagtctccggacggaccagagtgactctatcgccattccatgtcaccgagcaagccggatacggctcaatggtggcatcggcaaatacacctgttgccgtggcggtagtgccgcctgcgttatcgacggtcaccacatagcgggaaccgtcaaccggcgcattcggaatcgtcgcttcgctcttatcggcagagaccttgacggtctgggagtacggctgcgcggcgtaacgccacgaaccattgtcagacttgacggtcacggtcttctcgccggatacctgcggattggtccaggagaccttgacgttaccatccttgccgggttcgactttcacgccagacacggccgctgcttcgttcagcggcgcttcggcggccagcgagcgcgaaccgtccgcacccacggcgtacagcttcagcgtgccggtcttggcaggcaggtgcttgacgtacagggtgtcgtcgtaacggccaccgaggaaggtgttgtccaagtagagcaggtagttcttggcagtagagtaatcggcgagatcccacttgacggtggcctttcgctgtttggtgtgggtgggtctgtcaggtggtgacggtgctgaggtccccacactgcggaaaaacactgccgaacctgtcgaacaaacattgaagcaaaacaacatgccgcgagtggaccgcccccggtgtggggccgtggtcacgatggtgccgtgggccgagccgggcagccggttcacgcgcgactccgagtcggagtgcacatggctgatgagcgtcgcgaaccggaagacggtcagcggcttcctgcacgtcgcgtggaggacggccggagacatcgtccgccgggtcgcggaccgcctcagggccgcgatgccctcgccgttcgacggcctggcggcgatcggcgtggataccgcaagggccacacgtatccgaccgtggtccgacgcacggaccccaagggccagctctaccgttcatggcggctcgaggaaccgctgcgcctgctcgggctctccctcgaccgggccgggggagagctgaaccgctgggtgttccgggcctcgcatagccgcatccccgagatcgtcgagctttccaaaaaaaatcaggagacgccgccccgacatcccacgcaccatcgaaccgggctgctccaacgccaggctcgaggcgttcgacaacaggatcaaggccaccatccgcatggcctacggcttccaccgcgtcaccaacctcatcgccctgatcatgctccgatgcagcggattcgacatccgactaccacaacccacaatctaacccacaaaaacagcagaagcctctcaagtatccaacttttcgtccgcacccccacaaggttctaatcaggcattacagaaagcgcgtcaccggttccgagaggagtcggcggcgcgctttcataagggcacacaatcccaagatcacacccacagatcaataccgatcagtactcgtacgtgatcgcggggtcgccgatggtcggcgtctgatccagtttgaggttggctgagctggccgcggtggtcacgtcgtattcgatggtcaccgtgtcctgaggcgccagggagatgtcgtccatgtaggtcatatggtccttggcctgcacctgcgcgaaggaactgccgttcgacgccgacacattgctgacctcgcctccggccggcgtgtagatgaccacgcggttcaccgccacgcctcccttggcgttcgccgtgatgtattccggcagggatccggcctcgcccggctgcagggtgttggtgaacgaatacgtaacgtggtaggtgttgtcgccggtcctcttcaccgtcgacttgcgctggatgtaccagtccatcttcgaggcctgcatctcgttgaggtagacgccggccaccgggttcttcgcgtcgttggtgatctcgccggtgacgccggcgctgcgcagcaccgcctgatcctcctcgtggaacgaccagaagtacaggtgccgctgctcggtcatccggagcatcgtcttggcgacggtcatgagcttctgcgtgttcatgtcgctgaacaggtgggcgaccacctgggcggcggtctcgctgaagtactggtcctgagcggagggcgccagttccttgtaggcgccgttgagcaggaattcggcggtgttcgacccgttgagcacgcgcccgtcggacagggtcacgtcgccggtggcgccgatcatcgcctgcagcgcgacggggtcgagcgacatcacgccgtcggacgatccgccgaacggagccgcctgccagaacttctgggccatggacgcgacgcgcgggaagtccggcgtggacgaaagattatggacgcattgaccgaagtacagtccgctgtacagcgtgccgtcaccgtcctggttgacgtcatccaacgcggcgttggaggggaactcggcatccgcgtggaactcccccaccgcgatcttgccattgtccgcgctgaaggaaccggccgaaccgatcaggccgccggtgccgcggatctcggaattcgtctgggccagcagcacgtagttgcgggcgccgttcgcaccgaggaagttcggcagcatgttgagcatgccgctcaggttttcggtcacctgcgccagggcggccatctgcgtcttgccgttctgcagcgcgttgttcaccacgccgagtttggcgtcgggaagatcctggatcgtcctggcctgcgattgcacggactggtcgaccgtggcaagctgctgcgccgcggcgatgatcggctccatgtcgagctgcccatcgccactggagagactggcaccggtcagtgtggtgacgaccttgcccagctggggcagcgtggtctgcgcgaagtcatcgatggtaccgatggcggtgcgcgccgtcttcacgtcaccgccgaccacgggcatcttctccgccagcgtccacagaccgccgctgacatcctgcttggcggcggccgcctccttctggatgtggctcacgtcggacagcgccttgaccatgtcgtcggtggaaccgtccttgatgaccttggccgcgttgacaacattgttgaggtgcgctttggcgctcatcgccgacttgtacagtttgaatccgctgaagccggccgccgcggcgcacacgaccagcaacagcagcacgacgagcagcgcgttgcgaacgcgatgggttttcctggtgaccgtgcgtgcgtgtgatggcatgggctacttccttacgttatgacatatatcgatactggctggctgcccgattacgctttcgctggacgggtagcccggcggacggcacgtagcagtgcacgacgtgcacatcgcgtatgatgccgggggtgtcagcgcggctgactggggtggccgcggaccggatggagcaccggcaccgccggcgtcgtacaggtccgtggggaacgtgatcggaggaatgtcccagaacgtatcgacgatgtcgtgattggcaacgggaatcgccgtgcccgccggttcggacggggcaccggaacgccgctcatcgcctccgtgggctgcgcatcgcccggttgggcaggcccggacaccggagactgcaccatcgtgggctgatccgcgacactgttatgcgacgccggagccgttggcgtcgtattcttttccggctggccacccgttcccatgagctggcatgcacctttcagcgagtatttctcctaccgcatgccagtctacccatgcccgcgggataacccaaaaagccctgcaagaataccgatctttgaggcttctgatgtttttgtgggttagattgtgggttgtggtagtcggatgtcgaatccgctgcatcggagcatgatcagggcgatgaggttggtgacgcggtggaagccgtaggccatgcggatggtggccttgatcctgttgtcgaacgcctcgagcctggcgttggagcagcccggttcgatggtgcgtgggatgtcggggcggcgtctcctgattttttttggaaagctcgacgatctcggggatgcggctatgcgaggcccggaacacccagcggttcagctctcccccggcccggtcgagggagagcccgagcaggcgcagcggttcctcgagccgccatgaacggtagagctggcccttggggtccgtgcgtcgcgggctttcgaggtgcgctgccggctccagcgcgaacggacgggacggcgcggcaccaaggacgctctacaagggcaggaggatcctgctcaagaccgcgtccctgcgcaccgacaggcagaaggcgcgcgccgacgatctgctcaccgaccccgcgaacaagccgctcgccctcgcgcacggcgcgtaccagaagatcatctcctgctacgcgcacgaggaccggcgcaaggggcggggcatgatggccgagctcatcgaatccctcgccgtcaaaagcggtgcgcccggatgccccgaactcgccacgctcggacgcaccctcaaacgccgcatgggcgacgtgttcgcgttcttcgaccaccccaacggcgcgaacggccccaccgaggccatcaacggcaggctcgagaccctcagggacatagccctcggcttccgcaacctcgacaactacatcaccagaagcctgctccacaccggaggcttcagacaagccatccaaacccacctctaaccacacgccatacacaccaaaatgcgaagagccacataaccaaagagcctctgccgggaatcaaccggcagaggctctttgcatagagaataatcgcaatcagtaattgttatgagcgatccagtagttgtacgctgcgacgatgccgccgtagcgctgctcgcaatagctgatgaaccacttgaactgggtcttgtagttggtctgccagtccgcaccggcggaagccatcttgctaccggggtaggcctgacccaagccataagcaccagacgtggggttggtggcggtggggctccaaccggactcgtggttgatgatgtagttcgcagcggtgaagtctgcttcgctatacccgttgtccaacagatactgatgcgcccaggactgcacttctccagccggaacagtggtgccgagatcggccgacgacgatgacttggtggaaccagtgcccaccaggatcaccttatccaccggggccttcttgacccatgaggcgaatacgttggaagagatgaccttgtcgccggctcgcttgatcagcgaggtggtctccataatgcccttttggccctcggtctcgaccttttcctgacccttgggcaggctgctggtctccttgcgcacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgcgccgagcagacctgccgcggccaccacagccgcgatcttcatccactggcgcttgttcaacggtctgagcatacgggtcggcttggcatgtctcgtcattgcgctccttgatcggatttcacactgcccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcatcgatatcaaccttgacgaaggcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttttgtgttttccttggcatcgccgtacggccctcgtgcgtggccgccgggcgattgccttattcatgcaatacgtcttggcgcttggggccgtgcggttcgtggccgccggctccctgctggctaccagcttcccagcaccacccaacatttgtgtcgtattttccgccgccggccaaacgtttcccaagatttcgccggaaggtgacgcgtggcgtgtttttgcgcgcaataatgggatgcatgccagtcatgaatgatgaagtgcccgacgagggcgattatgatgccggccgtggccgcggcgaattcgacaacatcacgcccgaggacttcatccacggaggcggttccggtcacggcaacccgccgggctggctggggccgtccgacatcaaccgggcgcgccatcagatgcccatcgcgtatgtggagatcgtgcctgtgcgcaccgatgagatgggccgcatctcccaagtgggctcgctgctgcgcgtatccgaagacgggtcgatcgagcgtacgctgattaccggccgtgtgctgtaccacgagacgttgcgcgaggccatcgcccgcaatgtggccaaggatttgggcgatatcgccttgccgctgctgccgatcgggctccagccgttcgccgtggccgaattcttccccacgccgggactaagcgaatactacgatccgcgccagcacgccatcgcactgtgctacgtggtgcctatcgccggcgactgcaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaacgacaatggcaatcgaattggccaatcatatctaccgcgacggcgaaggcgtgccggtggtgctgatgaacgcctacccagtggaccaccgcatgtgggacgtgtgcgcgaaggcgctcgccgacttcgccgatctgaacgacgtgccggacttcccgatttgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgtgacacgatggccgcgtccgacggcgtgggcggagagaaccgactgaagatggcggacgccgccgaacagacgaactcggtcgaaccggtgatgcacttcgcgcaaccggccgatggcgattccaccgtcaaaaagactcctgaattcatcgcgaccatgaccggctggatcaacgaacagaacccggctggtctggcctggcgtcagcgcatgacctacggacggcctgaactgggggcggtgccggaaacgatcagcgcaccgagcctggtggtatccggcgaactggacccctccagcaatccgagtgtgatgcgtccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacctcgatgaccgctgacattcatttctcgcctctggcgctgacccatgcgctgccgttcctgccgctcgcacaaggtgacatcgactatcaggtggaccggcgaagcgaacccggcctgatcgacgagctgttggccgagccgaccaccaaagtcgtgcttacgcgcggcggactcgtcgccgtaccgcgcggccaaggcgagctcgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgcttggcacccaggattccggcactgtggacggcgcgctgggcaagaacggcatcagcggaggtgctgccgccggaatacggcagtcgggaaacgccaagggcaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccacgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggaacatgcatgggtggaccgttcggtcgaccccgcaatcatcggcattaccgaatacgccgccgaccagcttggcgaacttgtgttcgtggatctgcctgagcctggcgcccgtgtggaggccggcgacgagatcgtggagcttgaatcctccaaggccgtccagccgttgatcagccccgtggcgggtacggtcaagtatgtgaaccgtgacgtggcggacgacccgtccgtggtcaacggcgatccgtacggcgaaggctggctgctgaaggtcgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgctcgcagtgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggcgtatggtcacgcatctccactcaggtggtgcgccaatgggactggtatccgcgagtggaaccctatgtgggttatggcaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagattggcgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacttgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccaccggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgagggacatgacttcttccggctcggcggcttggatctgagcaaggacggccgttggatgctgtacggcgtggatgttgcgggagacgaacgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgccgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcattgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggtctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtatatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaggtcggcaaggacattctggcccgcatgtgacctcaaacttggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatctcatgctttgttgcatgacctggaacgagctctaattagcgatgattcattgcggtccgtattggacgcccatcctagttgccaaattatcggcacagatgaaattgccatcaaaaccgcatacagccgagccgtaagcagcaacttacccccgctggcgggggctccagcgcagcgggtgggggtgggcagccccgatgcgccgaacatcccagcatccatcaatacacaaaccaagcagcccgacaaaagctctgaataccgggagcgctggaacgccctcaagcctcaactcaccgtgatccacggccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaaccgggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcgtatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtagccgcgacagtgccgtttttcgcggtaacgcattcgtcagcatgtcgtacggctatcggatcgtgccacacatgaagtgacgaatgagggcatgctcctgacgaaacctgtgggggcgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtctgcggtgtccatgagccatggcacgcgcgtggtctggctggagcatgatgccctgttcgcatggcttgatgagcatccgcgtgtggccatcgacatgttgcaggtcatggccaaccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtggtcggtgccaataaggccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgatgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtacgatccgctggtcgaagagaaccagaaggaaagcgaaaaccaacgcaatatcgtgctcaagctgatgctgcaggaaggatacatcacccaggaccagtacaccgaagctgtgaacacgccgttgaaggacacgctgaaagtacaggacgtgaatgtcggctgtcaggacactggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaggacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcaggccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgtggcggcgggccgtgcggtggccgccggcttccaagcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtctaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtccacgccgacggcgtcggagacgtgctcgaatccgtcgcggcgcagcagctgggccagaccgcgcttcaacacggtgatctgctgcgggcctcggtacatcagcgagctgatgaacatgaccaggctggagccggaacgaatcttcgcataggcttgctcgggggtaaagacgccaccgatgccggcgatggcgaaccggtcgccatactccttatacaccttgcgaatcagctcggtgctggcgttggtgcacgggccgccggacaggccgccctcccaatcgcgcggaatcccgaggccggtgcggtccttctgcagattggcgatggacagcccctgcacattgtgatcggccagcacatcgagcagctccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcatcgaaatgcagtaatcctcaatgccttcgtccaaatcgccgcactggtcgtcgttggtgcgggcgatcgacacagacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcaaaaccgaagccggcatggtccagcaccacgggcatgtcgcagttcttgtcgaggccggcggacaggccgaacgggttggtgaaatcgacgcccatcacattcgtttccagaatggggtcggtgtagtcgagcatcagctgctcggcgagcagcagcggcgggacgttcttgacgacgtggcagaactcgatcatctgatcgtgtgcctcatcggggcggtggttgaacacgaagttcggtttgatgatgtgtttgtagccgaaggtgaacagatcggtggtggctttgttgacggcgtcgtgccagaagctttcagaaacgtaagtcataccgcctattgtctcacgcttgggccggtgcggctaggcgattcctgcctaggcgaattggggaaggggctaccgcgtgtcgaggcgcacgcaggcgtcggctcggcagaagatacatgaatcgggatgcaccaggtatcaggcgtgactcgccgctgagcaacgcgctcgggagagtcgtcggtcgtgagctatcgcgctagtggtcgctgcgagaatatcggttcgcacaatgtgcgattttgcgcggttttgtggaaatgaacacctgaattgcccggaattttcgagagattgtccccaaaacgctcaagccggtttggtttgtgagcttttgtgtgcgataatgttcacatgatttcgtcacaacgtcagcacctcatcttgagcaggttgcgcacgcgcggggcagtgcgcattacggcgctatcgaaggaactgggtgtgtcagcgatgaccatccgccgcgatatcgccgaactcgccgacaagggactgctgaagcgcgtccatggcggcgcggtgactaccagtaccttgctcagcgaacccctgttctctgtcaagtcccagatggatatcggcctgaaggacgccatcgcccaggaagccatcaaatatgtggctcccggcgatgtgatcgccatcggcggcggcaccacggcctatgtcttcgcccagcatctgctcgaatcgcagcagtccagcggcatcaccatcctcaccaattcgattcccgtggccgaactggtccaggccctcgaatccaaggacgtggaggtgatcgtcaccggcggagtgatcacccgatcgaactcgcttgtcggtccgatcgcggacaaggtcgtcgcctcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacatcgctgtcgctgtttgcgcgcttcgaccaagtggacacggtcattactgacgacgggctcgaccccgactccgccgccaaaaccaaggatttggtaaaggaactcgtgctggcccaccagagcgagatcattgaggaaagtgagtaaacccatggctgatttcgccaactacacccccggggagtatgcgaaggagcacatccgcatcacgccgacgacgcttgccgacggtcgtgacttcttctacctggacgacgaccccgagttcgtctccggtgccaagtcccgcgagctcaaggacccgcgcccgctggactaccgtttcgccccgcacctggacgccgacggcaacgaagtgccgtacgccgccccgcagatgcgccgcgacccgctgaccggcgactggatcccgatggccaccgcccgtatgaaccgcccgatcaccgccggccccggcgctaccgccaagggcaacccgctggccgcccgcaagcccggtgacccgtaccaggacggcgaagtgccggacaccgactacaacgtcgtcgtgttcgagaaccgcttcccctccatggtgcgcgtgcccggcgtctccgaggacgtgacctacgttgacggcaacccgctgtgggagaagaagctcgccgccggccgctgcgaggtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggccaggaaatcggcgtctccctcgcccacccgcacggccaggtctactgctacccgttcatcgccccgaagatggagaaggaactccagcacaccgaggcctaccacgagaagaccggcggcaacctgcttaaggacatcatgaacgccgagctcgaagccggcgaacgcatcgtgatgcgcaaccacagctgggtcgcctacgtgccggccgccgcccgttggcccctcgaggttcacgtggctccggtgcgcgacgtgctcaccctcgaccagctcaacgacgaagagcgttgggaccttgcctccatgtactcgcacctcctgaagcgcggcaacgccttcttcgacaagggcgacggcaagggcatggacctgccatacatcgccgcctggcaccaggccccggtgcacgacaagcgccgtgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgctctgccgcaccgcaccttcatcgccctgaagccgcgcgaagacaccaaggttcgcgtcgtctccggcgtggctcccgacaaggtcgccgaagctgatctcgatggcctcaaggcccgtggcgtggacggctggtccgcctacccgaccggtgtggcctgggcgctgcgtcaggctggtttcgacaaggtcaagggctttgatgccgccttcgtctcctgcgtgccgctgggctccggcctgagctcctccgccgccatgacctgctccaccgctctggctctggacgacgtgtacggcctcggctacggcgattccgacgccggccgtgtgaccctcatcaacgccgccatcaagtccgagaacgagatggccggtgcctccaccggcggtcttgaccagaacgcttccatgcgttgcaccgccggccatgcgctgctgcttgactgccgcccggagttgaccccgctggagaacgtctcccagcaggagttcgacctcgacaagtacaacctcgagctgcttgtggtcgatacccaggctccgcaccagctcaacgatggccagtacgctcagcgtcgcgccacctgcgaggaagccgccaagattctcggtgtggccaacctgcgcgttaccgccgacggcatctccaaggccgatgaccagttccaggccctcaaggaaacgcttgacgccctgcctgacgagaccatgaagaagcgcgtgcgccacgtcgtcaccgaaatcgagcgcgtgcgttccttcgtgcgtgccttcgctcagggcgacatcaaggctgcgggccgtctgttcaacgcttcccacgattcgctggccgccgactacgaggtcaccgtccccgagctggacatcgccgtggacgtggcccgcaagaacggcgcctacggtgcgcgtatgaccggcggcggcttcggtggctccatcatcgcgttggtggacaagggtcgttctcaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcaaggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggctgtgggcgactccgtgggcgaagtgctagagaagatcggcctcgaacaggtcggcgctcccggcaccacggcggcgctcgccatgctcaacgaccaggtcaagaagggcggcatcatggcgtcctcctacgtgggcggcctgtccggcgcgttcatcccggtctccgaagacaagaacatgatcgacgcggcttcttccgattgcctgaccatcgagaagctcgaagccatgacctgcgtgtgctcggtgggcctcgacatgatcgccattccgggcgatacctctgcttccaccatctccggcctgatcgccgacgaggccgccatcggcatggtcaaccagaagactaccgccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcagtagggtatctgccttcaaagaggtacatttgcgcagataggtatctgctttcagaggggtacctcaatcaagaaaccccgagtacaagcgttgatatttcaacgcctatactcggggtttcgtcctttaacagcccctcgaagcggcaatagacctccggcagatgccaaatcagcccctcgaagcgccgatagacccattttctgcgatgatggtcgtgctgcgaggctcagggtttcctctctcacgcctgtcggcgttcgttcggcgtcgctactcgaaggcccaccgggccttctcctcagcgccctccagcgaagttgagttggcgccaggcttcgtagatggcgatggacgcgcaattggtgaggttcagggaacgcaaggacgggcgcatgggcagtcgcacttgttcggccacatgagggccctccatgatgtccatcgggtcggggatgtcgccgggctcggggccgaacagcaggatgtcggtcggcttgtattccacctcggtgtacagcttggtagcatgtgcggtgaacgcgatgatgcgcgaattgggcatggactccaccaggttgtcgaaattcgggtgcagcaccacgtgggccatgtcgtggtagtcgaggcctgctcggcgcagcttggtgtcgcgcaggttgaaacccaacggctccaccaaatgcaggatggtgccggtcaccgcgcacaggcggatggccgagccggtgttgccgggaatgcgcggtgagtagtagcacagatgcggtgttacggtttcggtggtggcggccttttcagccgagagcatcgcgtccaccacggagatggggttgccatgcgcgtcggttacgagttcgtccggtccgtaattcgatttacggtacccgtactcgaacatcttctcgacttttgtttcgggattctgtgcgttctgcgaattctgttctgcttcgttcgtcatagctgctaagaataagaacgatgaacgacacagcaatttctttgcgattgggcgcatggtgggaggccaatgcgcgcgatttgccatggcgcttcggccgggccacgccgtggggcgtgctggtatccgaagtcatgagccagcagacgcagatgagccgtgtagtgccgtactggaccgactggatggaacgttggcccgacgcccgcgccctcgccgaggcccccaaggccgaggtgatcaccgcatgggggcggctcggctatccacgccgcgcattgcggttacaggaatgcgcccgcgtggtggctgaagattacgccgacaaactgccgcgcacgtatgacgaactcactgcattgcccggcatcggcgattacaccgcctccgcggtgatgagctttgcgttcggcgaacgaattgccgtgatcgataccaacattcgccgcgtgctgagccgcgtgttcctgggcgtcgaatcgcgcgggggagcgaccagcccggccgaacgcgcgctggcgaaccgcatgctgcccaaagacgagattctcgggtgcgatgctgacgtcgccgataatgccggtagcgccgaacatgtcgtgaacagcactatccgtggcggcaaacgctctcgactgcatcgtggcgagcgcccatcggtcacgtggaaccagtcggtgatggaactgggcgcggtgatctgcacggccaagtcgccgctgtgcgacacctgcccgattgcggacgactgtgcatttctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgcgggaacgtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttccccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgcaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacaatcaagtacctggtggccctgcacgacggtgcggcgaccttcccgggcaagcgcaacggcgaagacgttgacctgcgcgtggacgtcgacgatatcgatcacttcggcaaccgtcgtatccgccaggtcggcgagctgattcagaaccagctgcgtaccggtctgagccgtatggagcgcgtggtgcgcgagcgtatgaccactcaggacgccgaggccatcaccccgcagtccctgatcaacatccgtccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgctggtgggcaccggctccgaatggcgcgccgccaacgactccggcgacgtcatcaagtccgagaaggacggtgtggttacctacgtgtccgccgacctgatccgcgtgatgaacgacgacggcaccaccagctcctacaagctggccaagttccagcgctccaaccagactacctgctacaaccagcgcccgatcgtccacgacggcgagcgtgtggaagccggctcggttatggctgacggccccgccatccagaacggcgatctggccctgggcaagaacctgctcatcgccttcatgccgtggaacggctacaactacgaggatgctgtgatcatctcccagcgcctcgtgcaggacgacaccctctcctccatccacatcgaggagtacgagatcgacgcccgcgaaaccaagctgggcgccgaagagatcacccgcgacctgccgaacgtcggcgaggacgccgtggccaacctcgacgagcgcggcatcatccgcattggcgccgaggtcgaggccggcgacatcctggtcggtaaggtcaccccgaagggcgagaccgagctgaccccggaggagcgcctgctgcgcgccatcttcggcgagaagtcccgcgaggtgcgtgacacctccctgcgcgtgccccacggcgagaccggtaccgtcatcggtgtcaaggagatcacccgtgaggatgccgaggaggacggcgacgagctgcccaacggcgtcaaccagatgatccgcgtctacatcgcccagcaccgtaagatcacggtgggcgacaagctctccggccgccacggcaacaagggctgcatctcccgcatcctgccggaagaggacatgccgttcctggctgacggtactccggtcgacatcatgctgaacccgctgggtgtgccttcccgaatgaaccttggccaggtgctcgaactgcacctcggctggattgctcactccggttgggacatctctttggatccgaatctggaagccgagtggaagaagctgattccgtccggtgccgagaaggccgagccgaacaccccggttgccaccccggtgttcgacggtgtcaagcctgaggtcctgaagggcctgctgtccaccacgctgccgaaccgcgacggcgaccgtctggtcggccccgacggcaaggccaccctgttcgatggccgtaccggtgaaccgtacaccaagccgatttccgttggctacatgtacatgctgaagctgcaccacctggtcgacgacaagattcacgctcgttccaccggcccgtactccatgatcacccagcagccgctcggtggtaaggcccagttcggtggccagcgcttcggcgagatggaggtgtgggcccttgaggcctatggcgccgcctacacgctgcacgagatgatgaccactaagtccgatgacgtcgacggccgcgtgcgtgtctacggtgccatcgtcaagggcgataacctgccgccggcaggcatccccgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacatcggcgcccgccccgacgcggccgccaaggaagaccagaaggccgaagagcccgaataccagtgatccctcgggctgcatgcggtcaatacgccgcgtgtagctccgccaacgtgaaataaataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggacctggagcgcgtgatttacttcgcctcctacatggtcaccgaggtgaacgaagacgagcgtcacaacgatctgcccggcctgcaggacgagttcgattccgagatcaagcgccttgagcagcgccgtgactccgacatcgaagcccgcgccaagaaggtcgaagaggatctcgccgcccttgaggaggccggcgaggccaagggcccggcccgcaccaagttgcgtaacggtgccgagcgtgatatggctgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgaacagcgtaagaccaaggccctgaagcgcctcaaggtcgtcaacgccttcctgaccaccggcaacaagccggaggccatggtgctcgacgtgatcccggtcatcccgccggacctgcgcccgatggtccagctcgacggtggccgcttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacaccgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcccgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacagaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgatcgtcaccgaactcggcgatccaacgcttcaagccgggataacagcgcggattcacggcgacattggcaccgaattccggattctcgtaggcgatttttgccagcagaatcggatccgcgttcggatcctgaacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgggtgatgatgttgcgtggaatggtcgcctccgcctcttccggcaacatctgcccggaatcgatggcttcttggcgctgggaatggtctcgcgtgatgcgggtcagcgaagcggcgtcccacacgggaatgatatccgtggcgggagcatcggcatgcgccaacggactgagatggtaggtgcgggaatcgccgacattgaccacataggtctggtccgagaagtcctgatcatcggcgtcactgaacaaagcagcgctgcgggcgctggcggaatccgcatgatcttggggcagtaccaaaccggagcaggttgtgccggccacgccgccaaggcggtctcccagatcgagaatgtcgtgctgggcccgtgccaaggtgtcgtcgatatcctgacgggtgcgtgaaggcatggcggccaattgtgcgaaatgctgggcagccaactggcttgcctgctcgccgcctttgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgcaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggttttcggactgccgtgtcgccgcgctcgtgccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcaccttggtctccttgggcgtcggatagaacgccacccatcccaggccttgcaatttgatttccacccaagcggtcacatcattgccggtgaattcgattttggtgccattgcctgaagtcttctccgtgcgggcatcggtgatttcgccatcctcgtttttcggcaggaatcccaagaccacacgggagggcagtcccagctcacgagccatcagtgccatggcggaggcatattgttcggaatcacccaccatggccgtgcctgccagcagcttgttgatacggtaattgccatggcccgcatcggaaggataatcgccttccagaccgtgtgagaaccatccggagtctttcaatgtgtcggccaaggccgtggcggcggcaccgcccgaggactgcccgccggcaatggacgtggccagtttgctggccgaatcgggaacatcctgggctgaaggctgcgtgatgcgggccgcggccgcactgctgatctgcttatcggtgggcttgtgggctatgatgccggattcggtataggtgagtcccttgcgcgtgccggcgggaataatggcggaatcggtatccgtgttgtagtagaacgtgtcattgccgttgtcggcatcgttggcgaagctcacgccagcggccgctcccgccagcggcagccaggtgtcggtcagtccctgatcgacggtgaaggtcgcagtgaaggatttaccctgctcatccgccttgatcgtggtgcccacgcgatgataattcgaggagtccgtggcttcggaagaatcggacaggttccatactgtgccgtcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgccccccttccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaatcacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcaccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgatccggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcaggctctatggcactggcgttgtcgaggaactccatggcgttgcgcggctggccgtgcgcgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaaacgggaacgcaataaggcatgcgatgcctgcgcccgttaccgcccagcccaagggcgagacgtaggatgcgaagaaccgtctgatgcgtcttaccgcgcgcttgaacatgcgttcagcgcgccggcgacggcgtgatgtggcggatgtagatgccatggtcggatacctttccaggccctatcaggaaccgatggtgggggagggaacgtcttcgagcacctgtgcgatcaggctttcctgagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagtgccaaagcgccacgcatggaggagccgaccgtgatcttctcgttgtggcgggtcgcctcgacgagcctgacgatgtattcacgaatcgcatcatccacatagatttcggtggccacctgacgcagccgcatgacatcgtcaccgctcagcaccggggaaatggtctgcgcacggtcggtgatatcgacctgcttgaggatatcgacggacacatcatggcccgggtagccgattgacgtcttgataaggaatcggtccatctgcgcctcaggcagcttataggtaccgagctgctcgatggggttctgggttgcaatcacgataaacggctgcggcacatcatgggtgacgccgtcaacggtgactttctgctcttccataacctccagaagtgcggactgcgtcttcggcgatgcacggttgatctcatcggccagcacgatggaggcgaaaatcgggccttcacggaactcgaattctccgcgcttctgatcgtagaaagtcacacccaccacatccgaaggcagcagatcgggcgtgaactgaacacgcttgaaaccggtggaaatggaattggccaagcctcgggccaactgggtcttaccggtgccggggttgtcttcaagcagaatatggccgccgaccatcagtgcagtgacgcattgcttgatagggatggtcttgccgataaccaccttggagacattctcgaccagcgcattgaaggactgctggaaatcccggacctgagccgtgggctggggcagtagtccggaattgatgctggcgggcagtgccgatgcggctgcttgcgcggctttgctcgactgacgctgcggctgggattgtggctgtgattgcgcggtgacctgctgcgggatggctggcgtcgatcccttgcgcggcttgagcacggtgctgtcatcgcccgcagggatggaggcggcgtcagtggtaggagacggcttttctgacggcgcttgtgacggccgctgcggcaggttaggcagcgcaacggactgcggcgccgactcggtgcttggggtcgtgccggtgtgtggtgcggatgccaggtgcgtggcgtcggatagctgcgtgctgtcggacagacgggtcgtgtcagacaactgcgtcgcgtcatcgatgttctcgctcatggatgttctcctactgcttgtgaatggtggttgacgatattggggtattgccgaaaccaagaatccaggggttcttggccaaagtggtgacatcggtaccggatttgagcgacttggtcccctccgaggagtcagagggacgtgtgcccgcgacgctgcctccgtccgcagtgttgtcgagaccggagtatcccggcccgccggtgattttgacgctccacgcgtagttgccatcggcggccacagccaagtcggtgacatccaatggctggccggagttccacgtgaacggttggccattgatgatgatttgtacagtggccgacttgccatagacatcaaccgaaccgccggtgacgttaatgacgtgagcgttgtctgaccagcgcagctcctgcggtttgttgattacagccttcttctcataggtgtaaggagcgccattgtgcgggcctccggtggcggcgtcgctggtagcgccgttgaacacctgttgcaccgatgcggtgttgcatttggcccaaggacccattcggaagtcgagtgagttccggttagtagctgtaccggaatcgatgccatcggcagtcacgctgtaggactgcgcatgtccctgcttggtccaatgcacggtgcatgtactgccggatccggtggtgtagacgtcagcgggcggctggaccttgtactgcgggacaaagcggctctcgcccgtgccggcggaagcatcgcgctgcggcaccacggtggctgttacggtgatttcccgggtgttcaaatcgttctcattgatctcgaacgtagtgccactgtcactgcaatcgatggtgtccttgacgtctcctcccaaggaaattcgccggcagccggcattgcggttgttgccgagagtgactttcgccgttaccgtggtgtcgtcgttcgacaacgcaatgttcggcgcatccgggtctccccagatcttctctgacggcgatgcggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcaccgaatagttatcgacggcgctgaaatcaccgctcggcgctttccacgtcaccttggcggttttattgccacccgtgaccgtaacatcggtgggagcggacggcaccttgtccggtgtggcttcgacggcggtggacggcttggaccagccgacgtcatttcgcgcggcgacggtgaaggaataggttttgccgttcttcagaccagtgacctggcatgaggtgacggcaccgcaatccttctctccggtgacggcaccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtaacttcacgatccttggacttggtgccgtcttgcacggtgacgagcacggtgttcgtggaagcacccacatcggatgcgacggcgatggtgacgtttccggaggcatcgcatccggcgatggtgagtttggcggcgtcatccgccttgcagctgatgacggtcagcgaggaatcggggaacggattgtacgcgccggtaagcacgttcacggcatcgctggcaccggccttgatcttcaacgtcttgtcgccgacgcgtgccagcggacgggtcgaagacactacgcgcacggtcacaccggcattcacggtgcccgcgccgtatgcgatttgcacgggaatggacgcggtggtgccaggagcggcatccttggtggcggaaacctgcaagctaccggaacgggacaggtttgcggtgatttgcctggatgatgagcttccaccggaatacgtgtattgcttttcgtcgtcatacacgccggacggtgcatgggtgagcgccgtcagatcaacggtcttggggtccgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacatagaaatcggagttggaagccttggtggcgctgacggaatcagcgctttcgatatacggttccttgccggcgccgacgcgaacatagtcattgatgttgatttcaatggtctcgcgcgagttgactttcaattccggtgccttgggacgcaacgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcgccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcattcggatccacgtttaccgtgagggtggccgtatcggacaagccggccttgtctttgaccgtgtaggcgatataggcggtggtggcgctgccgggcgtggtgaaggagatcatattgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcgtccctggcgtatacgccggagtcggacgatccttggaatacgcccacgcggatctgcgcctgtgcgcgctgaccggtccaatcctccacggcataggagaaggtgtcggtgccggacgaatccggatacgcttcatagaccaagtagtcggaaccgacttcggatatgcggcccagcgtgggtgccttgttgcccagacccaacagctgatcgtcgtcgccatccgtgtctatgccggtcagtgtgatggggatgcggaccttctgcccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagccccttgaacgtctccttgtcgtattgcaggttgttcttgagtttgaccgtggtgccatccgagtaggccacatggtcaagcacatccacggacacgatgccgccggtacgcacctgggcattgatattgctggctttgggcactgaattcgaggtggccagagccggtggctgcaacacgatggtgcccttggcggttccggaggcgttggccacggtgtaggtaagggcgacgggcttcgtgggcacctgacgcgcggtgatatacacgcgcttatggctgacgagaccaaccttgatgccggagtcggccggtgcgctcaccgtggtgacggatagcacgccgcccatcggatcgacgtcattggtgagcggctccacaatggcggtattatccgcgccaagcagggcgatatcgttggcggcaaccggtttggcggcctcgccggtggcgggctgtacctcgactcgagccaatccggtggccggaatcgaaccttgagcaatggtgtagggcacgtaataggtgcccggattggtggccttgaacgtcaacgacatatccgccgcattggtggtcgtcgaagcgccgttgggcgtatccacctgagtcagctgtgccggctgcaaggaagtgccatgcacgtaagaggacagcttgacgacggtatccgtgttgggaacggtggttttcgctaccgggtcgatgaccgcggccaaggtgttcgcgggcttgaccgagaaatacaccatgccggtgccggtcgccgtgccgtcggagacggtgacctcgacgcccacgcgtcccgacgccagcgcaccggtgttgaacgtaagctggccgtcggctcgggtggacacctgcacctggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcgaccatcggaaatatcgtaagtaaaggtaacggtgcctgcggatgcggcggaggcatcgagttgcagataccggccgtcgtaaatcggtgaaatggtgacgtctttgttgtttggtgcgccaaccttggtgattttcagtacggaacaatcggtctgctcgtcattgcgcagcacgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggtctgtattttgttccactgtattttgatgactttggtggaatcctcagggttccacacattgccgttaaccgtgtcgttgagcaccacaaggcgatggttggtgcggaacaccaattcggaagtagtattgacggattcgagggtttgcggcttgacgctggtatccgtgggggagcaggcgcgaatgtagttgctggccttctggctccaagccgagtacacgcagcccttggacgataccggtcgtgctggattcgccttgcccccgttggctatgaaattcgccttggcattggacttcaacgggataagcgcaaggcctctcggtgatgccgcggccacccaatcggactgtatgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttggccttggcgctgctgggattgtcaagacgcagcaccataccgtcggatggacggtatccgtagaccttgccatcgtgggttactgcgatgcgcccgccctcgcccagctttattttcggatcggaagtggtgggggtcacggaatcaaggttttccgacaagccggtccacacattgccggtcttctcgttgatcagggctgcggtatccccgccgaccacagtggtggtgttggctttgatgtcggtcttgacaccggtgctgaccgtggatgccttgatggtggaggctttggtcgtttcggtcaggatggtgtcgccattatgctgtgcgatgtcgaatcgtggggcggaggaggagacgccggcgtcggcctccttgttctttacgttgaatcgtgcggccttctggtttttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgacccctgttttctctggttgctggtgtaatgacaacgctttacggttccaatacctgccgttcctgttgtccatttggtgaattcgccgctgctgggcgcacgtctgatgcgatacgcaatgccagggtggcatgcccggcagtggcgagcggatcattcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgcataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgcttccacatcggccggcacgtcggggcggttgaggcgaggcaatggctggttgacgatcagcgaaatcagttccgattgcgaacgcgggtgataatcgtgctggaatggcgagcagccgacgaacatggcgtacagggtggccgccagtgaatagatgtcggcggcttccgaaccattggtcagatgctgaagcacctcaggcggtgcccacggcggcgagaatccggtttcggtgcggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggcttcgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctgcgcgtctactttgcccaggatgactgggcgagactcatacgcgatgccggtgccggcgagatgcccggctcggccgcttccgcacaatcaagcctctcgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggcgctcgtgtggtgcgtgaggcattcgccgccgatcacgcggatgattccgaccggcctatgtgtgtggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgcggatcgtatccggaatatctgatgcgccgtgccgtggaagggcggctgaaggccaaggaagaacagctggttggcggcagtgccgtcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcaggcggacggcacggtgaccgccggcctgtaccgatcctcacgtgaggagctggatgatgtggtctggcgcatcaagcgggcgcatcttgaccggcatattcggtggaacgacatggcggtcatcacccacgacaatgccgccgtgcggctgttcggcgaacgactgcgccgagatggtgtaccggtgcggtattcgtcggtcacccgtcctttgaaggacgagactttcgtgcagggattgttcgcgcttgtggagcttgcccgattgcgtgccgaggggatggcggaatgccagatgacgttggcttcctgcgcggcatatataaggactagagtggccacgttgatgaacggcccgttggtgagtgccggggccaaacccggtcaggggcgtcccgcaaggcttgcgccgatcgaatcggccatggggtcgttggagtcgctggcgcatctcgccacggatgatgccatgctgacctctctgacgacggcatgggaaacattgcgtgaaacataccatgaaacacggcgtgaaacaggtcgtgaaacatcctcgtcagtggtttcgacgtcagcggtttcgtcgtcagtgacttcgttgccagtgtctgtcgaaatactcggtgaaccgtccggcgatgacttggcctttggcgttgacgcgctgtacgtgatgcttgccattgatgatgccgccgcgccggcgcaggctgcgctcgcatccatccacgcggtgctcggcaacgaccctcaggcccgcgcttttgcgaacctgtggcatctggtgggcagcgttgcttccggcttggagcggctgccggcaagccagcgcgtacagccgcgctatgcgctgtctgttgcgtggaacgccaccggtctggcaccggtctggcagcgtgcggcattattcaacacggcagaggggcgtacggccaatgaccggctggacgcggcaatgcgcctgttccagttcgccgatgattccaccgccagtcgagacatcacgtcattcatggcacaggttcggggcatggaagtgcaggccgattccttggcccacataggaccggtggaagacgcggtgacattgactacgccggcaggcgcggccggacgccactgggaatatgcgtggataccggtggtccagcaagacgtgtggccgaacctcgccgggcgcaacaccatgttcggtggtgaagaccttgccgagctcgtgctgaggggagcgcttgaagaaagcgacaaaaccgggcatgatccgcggttcgcggctgtattgtcgggcgagaagaagagtttcctggtcgcgctgacccgtgcacggcgaatcatgatcagcgcggtatggaacgacagcatgagcccctcggactttctcttcgggtatctgccggaatactatccgcgcaaccggcaacaggcgcctttcaccacagtgggggcacatgcgggattcgccgaatatgatctggccggattggacgccgacccacgtgggttggtcagcgccgcccgcgcggttctggccactgctcaaccgcagcaggctgccgcaaaggacgccgcgattgcgttgacactcctgttagagcatggtgtgcgcgccgcaaatccgcagagctgggcgtttgtggaatcgccggcccaatcggatagcgcgtcatctggcggtgcgtcatctggcggtgcgtcatctggcgatacctcatctgacagtgcctcatccgacagcgcgtcatctggtggtgtacagcctgacggtatccaaacagggaaaggcaagacggatgcgcaggccgcgcccatggtcaccttatctccatcggcggtcgacagcctatgggcgtgcccggtgtgctggatgctggagaaccggttcgccggtcctcgccccagctccgtggccaccagtttcggaaccctcatccatgcggttgcgcagcaaggcagcgaggaagggctggaccatctttcccacaatgcccaggcgttggccgcactgggcttggactccacggccggcacggaacgtcgcatcgaggctgtctcggcacggcttaatgccatctatcagagcaaacgtcctgatccgaatgccatagccgacacccggaaccgctatgaggccacccgtaaggacgagtccgcggcggataccctgcgcaacatcgccgattactttgtgcgcagcgacgccgatccggaaacgtatcttggcaagaactccagcaacttcagcattggcgcattggccggtgccgaatgcgaacgggagtttgccgcacgattcgatgtgcgtgacatactcgacgcatacaatgccgtgcccggcctgcacccaatcggtcggaacacgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatttgcagctcgtgtgctatcagcttggcctcgtgttccccgaagacgggccgcgcggtgccaaggcacttgccgcaatgccgcatatcagccaaagcgtgctattccatgtcgggcagaatgcggcaccagccagaagctacgctccggaaggtgccttccagccgccgctgttcactgatggctcgttgaatgccgaaccgttcacgccccgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcagatcagccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagacgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcgaattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcgttctggctgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccatcgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaactcgcccagctcgacatgtaccgactgctgctggcagcggtcgaaggtgtggaattggacagtatcgacgccactctctactatgtcagtgagcccgacgagggcttgcgcgagcttcacgcccgcgcgaaaaccaaacaggaaatccttaccgagttgagctccggcattcccgaacaatctgacaacgactgagcccaaaggctcatgacctgtacagcatcggacggccttcaccggcggagagaccttatgcatcgcaaggcatctccgacgatgaagacgactggccacgtaccggtccgcggttgaaacgcgccgcgtgacgttgcttgggaaccgctacccctcggatggcacgtgtgggcgggcgcacgtgccggacaacgcaccagtaaggagttattgtgtccacgactcgcgcggtttcgaagtcgtccgctgcccactcgccctatcagcgcctgttcatgctgcccggagccaaggcgttctgcctgtccggtgcggtggcacgattgccgatctccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggcttgcgctcgccgtgcagatcgtggccatgctcgccttcgccttcgcggcgttggtgcgcgtgccgattccgctgctgttcgctttggccatcatcatgggtctgacgcagttctcattcggcgcattggtccgaacccgttggtcctatgcgttgcgcggtgtggaagatggcgaacagctgctcaacacggcctacgccatggaagccgccattgacgagatcgtctttattctggggccgattctggcggcttggctggccacctccgtgcatccggtatcccaactgttcgtgcccaccgtggcatgcggcatcggcggcaccatattcttctcgctgaaatccacccagccaccggtcatcgtggaacaggtcaccgtggccgcgcacgatgacggcagccccgctgcaagcgaagatgccgaccagctgaccctacgccagctcaaacgcagcggtgccaagcccaaaagcgtattgctctataccggcgtactgccgttgctcgccgtgttcatcgtgttcaatatgagcttcacgtccttcgacgtgtccatcaccgccaccatgaaatccatgggacttgagcccttcctcggtctgcaattggcgatgttcgcggtcggctcgtgcatcggcgcgctggtgttcggctctcgccaactcaaaggctcccattgggcgcatatggtgatgttcctgtcgctgctgaccgtcggctacgtgttcttccggttgtcaatggacaatctcatcctgctgggcgtcttcgaaatcctcgccggcctgaccgtctcgccgacgttcgccaccggcaacctcatcgtcaaggatctggtgccggcggaatccctgaccgaaggactgagctgggtaaccaccgcaggcacggtcggcacgtcgatcggctcgtccgtggccggcattgtgcttgacgcctccaaccctcatgtgggcatgatgctgccattcatcttcacgctggcgtccgtgccattggcgttggccggatgggccttggccaagcggcgtgggtgaaacgggatcgggctacgcccgatggatggttggcggcttcgccggggtctctccctcagtccgcttcgcgtccagctcgaacgcaattaatgatggctttcagccaactgaattattgctcactgtcgttcgccctcacctaaaaacgcctccggcgttttcttcacggttcggctcatcagagggagctcgacttcacggttcggctcgtcagagggagcttgattctgtggacggggtattggcgtgagggcttggcggtgataggctgattgccgattggaaaacgtcccgggtacattgccgggcaggtacgggtagacagggaagaagacatgatcaaggtttcggtggtcggagcaaagggccgcatgggctcgcacgtggtcgaagcggtgaacaacgccgaggatacgcagctggcgctcgcattggatgccggcgacgacctgacccagatcaccaccgacaacaccgatgtggtcgtcgaattcaccgtgccgtccgtcagcctgaacaacgtgctgaccctgatcggccaaggcgtggacgtggtggtcggcaccaccggctggaccgacgagaaactcgcccaggtcaaatccgccatcgccaacggtccgaagcccgaaacccagaaggtcttcatcgcacctaacttcgcgatctccgccgtactggccgactactttgccaccaaggccgcgaaatacttcgaatccgccgaagtcatcgaactgcaccaccccaccaaggtggacgccccctccggcactgccatccacaccgcccacggcatcgccgaagcgcgcaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaacgccggcgagcagctgaccattcgggccgacagcttcgaccgcaccagcttcatgcccggcgtcctgcttgccgtgcgcaagctcgccggcgacgctccggctggcctgaccatcggcctcgaccacttcctcgacctgtaatcgacccgcagtcgaccagtagtcgcccccgcatttcaggcagggaagcgcgccgggacgcgcatcacggcattgccaccggctccggccataatgccacgcattcagcaacaatcaaggtacgtagtataagagtccacaatgggaagtacggtaaacactatgagcgagcatgacatgcaccttcttgattcagcacctttcggccgcattctgccggctatggtcaccccgatgaaatccgacggcagcgtcgatttcgccgccgcgcagaagctcgccaaatacctcgtcgccgatggcgcggatggtctggtggtcaatggcaccaccggcgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggcgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcgaaacctacgaccgactggccggacttgaacacgtcaaggctgtcaaggacgccaccggcgatcttgcagccgcagtggagaagcagcagcgcaccggcctcgcctggtattccggcgatgacggcctgttcctgccgttcctctccatcggtgccgtcggcatcatttcggtgattgcccacgtcgcctccaaccccatgcagcagcttgtccaggcattcgatcgcggcgatatcactaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacgccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggtgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgcccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaaaatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggctcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgaaaaccgccatctggtggccaacggcctgatcgccgtcaagaccggcgtggacccgcagaacgtggttttggccgaagacggcgatgtggtcgacctgtaccacggcagggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggttcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaagacaaccgcatcgaactgaccgacctcaaggagaagaacgaggtcaccgtcgaagccaggtgccgttactccaacactggcgagggcctgcaccgctcggtcgacccgtccgatggcaacatctacctgtactcccagttcgaggtgccggacgctcgccgcgtctacgccgtgttcgaccagcctgacctgaaggccaccttcgacttcaaggtgctcgctcccgccagctggatcgtcacctccaacatgccggttgccgccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggccgtaccgtgccaatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgcgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgccgaagccaccgaatggcatgacgcttgggccactttctgctccggcgagaagagctgggcgctgcgccaggatcagctgcccaccacgcacccgatcgtcgcgccgatcaacgacctcaacgacacttacgtcaacttcgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggagaagacctccggccgcgatctcaaggcctggagcgccaagtggctggaggaatccggcatcaacacgatcgccactggcctgaccgtaaacgcggacggcaccatcgccgaactgaagctcacccagagcgcgccggccgaacacccggtgctgcgcccgcatcgcctggccgtcggcttctacaacgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgcccggtatttcgaggccgtcgactggatctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccgtctggctcccctcgggtgcgaggggagttgtcgcctcaggcgactgagggaatcgcttccgcgaggagctacgtccacattccaacataaaacccgcaaccaatcctcaacagcgtattctcgctcaaggccggcaatgtgccggtcgatgagcgacaaggatacggggaatgattgcgggcttttccataacttcattactactgattctgttggccggaatcggcgcaggattcgtgggctatgcggtaggcgcatcgtcactggtctcatacccggccttgctcgcgttcggcattccgcctgtattggcaaacgcttctaacaccgttggcgtggttggcacgggcatcggtggcgtgatgggcgcgcgcaaagaactcaaaggccaagcggtacgctccattacgtatgtggtcattggcgcgttcggcggggtggccggtgcgtttctgttgctcaaactcgacccgagtgtctttgaattcgccgcaccagtgctgattttgctgagctcgctgatcatcgccatcaatccgcgcggccgcatgcaggccaagcaggccgccgcggatgccaccgcgcaactcaagcacatcgaagccactgaagccaccgatgccactgatgccgccaagcgcgcaaccacccctaccgcacctcaccgcccgccggaacaactcgtgcagcccatgagccaggattcctggtgggtatggctgggcgtggtggcagtcgccatctactccggctacttcggcgcgggcgccggcaccctggctctcgccatgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggctgcttcatcggcgggtacatcgccccgcccatcacccgcaagattcccgcaaacatcatgcgcgccgccgccgtaatcgccggcatcattcttaccatcgatctggggctcaaaacctattgattcatgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgctgccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggttctggagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgaccgcacgtctggcgttggatttgggcgatgccgccgtgcgtgtgctcggcgacgccggcacccaagacgatcagcctgaggggcgccgccgcgcgctcgtgggtcgtgacacccgtgtgtccggcgattttctggcttccgccctgtctgcgggcatggccgccggcggattcgacgtgatcgacgcaggcatcatcccgaccccgggcatcgcgttcctgaccagcgtgctcaacgttgagatgggtgccgtgatctccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccactgccaccaacctgtacatcgatcatctggtggccaccatcgctccgctgaacgatgacaaaacccagcccaagccgctcaagggactgaagatcgtggccgactgcgccaacggcgccacttccgtggtggctcccgaagccctgcgccgtgccggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgtctcgccgtggacgaagacggcaacatgatcaacggcgaccagatcatgggcattctggcccgcgccaagcagcgcgaaggcaagctcaaccacgacaccctcgtggtcaccgtgatgagcaacctcggtctgaagctcgccctgaaagatatgggcatcaagaccgtggaaaccgccgtgggcgatcgttacgtgcttgaggaaatgctcaagggcgattactcgctcggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaggccgcctccaccaacaagcgcatccaggatgccgtggcccgtgaggaggaactgctgggagacaccggccgtgtgctgctgcgcccctccggcaccgaaccgctcgtgcgcgtgatggccgaggccgccacccaagcctacgccgacgaagtctgcacccgcctcgccaagatcgtcgccgaagaactcgcgctgtagcacccttccctaaggaaaaaaaacaatgtttggaaagaacgccaaagtcgacctcgaactcaaccgtgatgtcgaacaactcatcaaaaccggcggcaaggagaagctcctgcccatcgtgcaggccggcgaaccggtgttgcgccaacggacagtggcctataatggccagctttccaagcgtacgctcgccaaactcatcgatacgatgcacaccaccatgctggaggcacccggcgtggggctcgccgccacccagatcggcttggggctcgcgctcgccgtggtcgaagaccacgtgcgcgacgacgaggatgatccgcgcgaaatcgcggaattccccttccacgtgatcatcaacccgagctacaaacccaccagcgacaaaaccgcctcgttctacgagggctgcctgagcttcgacggataccaagctgtgcgcaagcgttggctcgacatcaccgccgaatgggatgatgaagacggcaaacaccacagcgagccgctgcacggctggcccgcacgcatcttccagcacgaaaccgatcatttgagcggcgagttgtatatcgatcgcgccgaaatccgttcgctgaccaccaacgagaacctcgaggactactggtgcgaagacccggtgcccaccgaggccgctgaagagctcggtttcgcactatgaccgaccgtgcatggttcgacgccgccaagggagacattccccaatgggcggcatccatgcccaaggacgccgatggcaccaccatcgactgggactgggtgcgttctctggacctggcgcatggcgtcggcacaataccggaatccaccccacagtccatccacgacgcattgaaggccgactacgccacacgcgagcgtctggaatcgatcatcgcccaatgcaacagcgcattcatgaccgatttcgaccggttcatcggctcctatcgtctgcctcgcgcgctcgcctacgccaatcgtcggctcaacgacaacatcaacacgctgttgcatctgggcgaacagcaacacctatgggcggtcagtcgcgaacggcgggggagggccaccattgccgtgctcaagccgtactccggcagcggcccgtcgaacgatgaccaaggcatgctggatctgagcggcgaagccggtggcacatctgccggaaacactgccgccgaaaacagcgatgtcaagttccccacaacagtcgccttggacgatgtccaagatcgtacggcagcgattcttgacgcacgcgccgaacggcgtaaggcccagcgcttccagaagcgggcgggcgatgcggcgatggcccgcgccaatctctccggcgcgacttcgccgggtggtgccgctctgccgggtggtgccgccgcgtctggcaacgctaccggacaccatcccaagcccgactggcgcgacgcctacctgcccggccgcgacgtggatgcggtgatgggcatcgacatcgaaaccaccggcatcgatccggcacgtgactacatcatcgacgtcggcttcgagttcatgaacatggccagtccgcgcccggccggcgaacccgagacatacgcctatgagcagggctattacgccgccggcgacgcctacggccagtcccgcctcgcttttggcgtgccgccggaaaacgcggcgctcggcaacgccctcatcgccaaactcaccggcatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacctgggccttgaggattcgcacatcatgctggtggccatgaaacaccatctggcggcgctgaaagcgcaagggaaagggccgtgggggtccaccggcagggcgggcgtcggcggcaagtcctgcggtcgtaagcggtgagtacactattggtctcgtgagtaactatcaggacagccgacagcagcgtgagaaccgccgccgcaccatcgtgcgtgtggtgtgcgtggtcatagctgtggccatgctcggctccctggtcatcccggcgatttacgcggggctttgacgttgccttcgcatattcgtgcccgcagttgaacacgtctgatgcgagggattcgtgaggtcgcccggccggttatcggcaaggcaggcccggaaccttctgacagcatggattgcaggcggatgcgcgtgtggcgcggcaatgcccgccaacgccagaggaatgtgcgaaggctgtcaacaaggacgtgacttcccaaggaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccgactgtccgccgcggaatcgcagctgaagcgtctgaactccgcctcccagcgcatcgacgatgtggaaacgctcgtcgaactcggccacgaggagggcgatcaggactctctggacgaggcgcaaagcgaaatcggcgagatccagaaggatctcgaccagatggagattcagaccctgcttgacggcgaatatgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggcgggcatcaagtccgccaccttccaggtggacgccccctacgcttacggccgactgtccgtggaaggcggcacccaccgtctggtacgtatctccccgttcgacaaccagggccgccgccagaccagcttcgccgccgtggaagtggtgccgctggtcgaggccaccgaccatatcgacattccggatacggacatccgcgtggacacctactgttcctccggccccggcggccagggcgtgaacaccacgtactcggccgtgcgcatcacccaccttcccaccggcatcgtggtgaccatgcaggatgagcgttcgcagattcagaaccgtgcctccgccatggccgtgctccagtcccgactgctcgtgctgcgccacgaggaggaggccaagaagaagaaggagctcgccggcgacatcaaggccagctggggcgatcagatgcgctcctacgtgctgcacccctaccagatggtcaaggacctgcgcaccggctacgaaaccagccagactcaggccgtgttcgacggcgacatcaacgcgttcatcgaggccggcatccgctggcgccatgaacagcgccgcgccgccgaaaccgaggagtaaacagcattatggcactgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaggaggccaccagcggcgagattcgcgtggccggcaacgatctgcggcgcatcaccaaccgtcaagtgccgcagtaccgccgttcgctgggcttcgtgttccaggattacaagctgctcaataacaaaaccgtatgggagaacgtggcgttcgcccttgaggtgatcggcacgcggcggtccaccatcaaatcgttggtgcccaaggtgctgaataccgtgggactcaccggcaaggaaaagaactatccgcatgagctctccggtggcgagcagcagcgtgtggccatcgcccgcgcctacgtgaatcacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctacgattccgccctgttcttcccggatgccgaagtcgaagccaagtccgacaccgcccatcatgtgctggcggcggcgaccaaggccatcgagggcagtgacgagccgtctgaaggcatcgcccgtttggccaattccgtgcattccggccgcaccggccgctatggcgagacgtttgcgccgctggaagacacgctgacctggggcaagggcattccgttggatgagcaggccgccgccctggaaagcacccaggcgttcgacccgttcaaggacgagtccgccgcgaccgccgcggttgccgatacgtccgtgtcatccgccgccgagccgccggccccgccggaactgccggccccgccggagctgcccgcaccgccggagccgcccgccccgccggaaccgcccgcaccgccggccaacgagcagtccgccgccgagcagcctgctgacgagcagtccgccgcagaccaaacatccgacgatcaacccgctgagggcgcgaaggagtaagggggatcatcatgcgagcacgattcattctgtccgaaacgtgggccaacctcacccgtaacctgtcgatgctgctgtcgctgacgctggtcaccttcatctcattcctgttcatcggcgcttcggtgcttacccaggcgcagatcaccaaagccaagggcgactggtacgacaaggtcgaggtcgtggtgtggctatgtcccgacggcaccagccagtccgcgaactgtgcttccggcaaatcgccctcagccaatgagatcacggcactgcagaaaaccattcgcgatgaactcaacgacgtggtctccaacatcgactatgtcagcaagcaggatttctacgacaacaccttcaccaagcagtacccgaacggtgaattccaaggccgtacgctgaccgcggacgatatgcaggactccctctggctcaagctcaaggaccccaccaaatatcaggtggtctccgaagtgctctctggcaaggagggtgtggaagacgttaccgatcagcgccagatcttcgacccggtgttcgccgtgctcaaccgagccacggcggttacggctgtgctcgccggcgtgatggtggtggtcgccatcctgctgaccggaaccaccattcgtatgtccgccgcatccagacgaaccgaaaccgaaatcatgaggtacgtgggtgcctcgaactggacgattcgtctgccgttcattctggagggcaccatcgcctcgctgatcggctcggtgctctcgtgcctgatgctttcggctatcgtcaacgtgttcgtcaccggctggctggcgaaatccgttacatggattccttatgtgaatcagctcacggtactggtgatatcgccgttcctggttgtgggcgcgatactgctgtccatcatcgcttcaaccatctcgttgcggcgttatttgagggcgtaacgtgaccggcttacccgcgagaaatgtgatgacatcgtgtgcaagcctctcaggttcgcatgttatggtattggcttaagtgagcgaaaggactattcacatatgacgaacgtacgtgtgatcaagcccgcactggcggcactggtggccgccgcagcctgtgtgggaggtctggcgttcagctcggcacagcctgcccaggcagacacctattccgacctgatcaatgcgcagaaccagcacgccgcgtcggtacagcgcgaggccgaactcaagcagcagctggccggtgccagccaggacctggcgaataaggtacttgagctggacgatctgaccaacaacaagattgtcgccgcgcaggccaaggtcacacaggccaacgaggatgccgccaccgctcaggacgaggccgatgccgcatccggacgtctttccgccgcgcagaaagacaaggagacgcttgaggagcagatcaagcagaccggcagggactacgatgacgcgcacgccgccgtggcccagctggcccgtgacgagatgcacggctcgaatgcttccgacgtgatgagcgtggtgacgggtgccaccagcacacaggacttcgtcaattccatgcagtcccgggacgcgttgtcccgcaacgaggcgaatgcggcttcctccgccgcgacctcactgagcacgtcgaagaatcgtggcgagcgcttggcggccatcgaaaagcagatcgctgtgctcaagacccaggccgatgagaaggccgcttccgcacagaccgccgccgaaaccgcgcaaagcgaacgtgacgctttggataagctgcgccaggaaggcgaagcaaggcgtgacgaactgtcttccatgatcgacagtctggattcccaatccgccaagcaggcggcccagaccgtactgatcgcttcccaggtcgattcctacaatcgtcagttccagaaggagcagcaggacgccgccaacagggtggataccggtaaccagggcggtacgccgtctactccggtgacccccgctccggcgcccgctccggctccggctccggcccccgcccccagcgtcggcggccaaggcacgtcgaacggtgattacggcaacgcctatgccaccggccagtgcacgtactgggcgtatgaacgccgtaggcagatgggcattggcacgccgtcctatctcggcaatggcggcgactggtggcgcaacgccccctcgtacggcttgcgcgtggaccacaaccctcaggtcggcgccgcgctctccttcctgcctggtcaggacggtgccgacggtacctggggccatgttgccgtggttgaagccgtgtatggcgacggcacattccagatctccgagatgaacgtgggcggcctgtggatgatgaactaccgcacgctgaccaatttgggtcagtactggttcgtccactgaccggttggttcggccgatatatgcggttgaagggttcctcttgaagaggaaccctttttcgtattcgaggccggtccgtgatatcgtcggatgttgcgttgctacccacgagttgctacccacgaaaggaggagacatgcccaaggaaaccggtgagaaactcatcgtccagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgcggcgaaatgtggctggagggcgcgaacatccccgaatacctgaacggcacatggaacaaccatgcgcccaagcgcaagcgcaagttgctgctgcaccgactgcagatcaccaagctcgcccgcggcatcgaggccaagggatacacgattgtgccgctgagcctgtacttcaaggacggtcgcgtcaaggcggagatcgcgctggcccgaggcaagaaggaattcgacaagcgccaggccctgcgcgaagagcaggacaagcgcgaagccctacgcgccatgcgctacgccaacatgcgccactagtcccgccccttggctcccctccggaggggagccaagggtaggatgtccgcgttgtgggtcatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccgtggcggcctgtggcacgactgacggcaccgacaccgcatccaagagcggcgattcatccaaggactcgtccagcacttcgattcaaggcttcgacaccggcagcatccagaaggacgacgagattgccgcactgctgcccgattccgtggccggcgacggcacgctgaccgtcggcgccgatacttcctatgccccggccgagttcctggccgaggacggcaagaccccggtcggctttgatgtcgacctgtccaaggcgctggccgcagtgttcggactgaaggaaaacaccgtctcctccacgttcgattcgattatcccgtccgtcggctccaagtacgacatcggcatctcctccttcaccgtgaccaaggaacgcatggaggctgtggacttcgtgacctacttcaaggccggttccacgttcgtggtgcagaagggcaacccgaacaaggtcgactcctcgaacctgtgcggcgtgaaggtggctgtgcagaccggtaccacccaggaagaggaagtcaacaaggccaacgagcagtgcaaggcggacggcaaggatgccatcgacatccagtcctacaagctgcagaccgatgtgactaccgccgtggcttccggtaaggctgatatcttctacgccgatacgccggttgccggctacgccatcaagcagaccggtgatacgctcgaggccctcggcgaggacgttggtgtgacccctgaggccgtggccgtcaagaagggcgattccaagaccgccgaggccgtacagaaggccatccagaagctgatggatgatggcacgtacaagaagatcctcgacacgtggggcgtctcttccggcgccgtcgacaaggccgagatcaacccgtccgtcgagtagtttcggttactatgaagactcccgttgccctgcggcgggagtctttttgtatatgtatgcactgtagtgtataaatatgcttaaccgttgatcgttgccgttgaagcggcgtaagagagaagaagaaacgattatgcagtccaccaaactgaagtccattatggccattgcactgagctcggccatgctgttcgccaccgccgcttgcggcacctccgacaaggccgatgccggtacggattccgccaagggctccgatgccgccaccatcaccagctacgatgtcagctccgtggagaaggatgacaccatcgccgcactgctgcctgaatccgtgaccaaggacggcaagctcaccatcggcaccaacccctcctacgccccggccgaattcctcgacgccgacggcaagacccagatcggctacgacatggatctcgcccgcgccatgggcaacatcttcggtctcgagaccgaaatcgtctcctccaacttcgatacgatcattccggccatcggctccaagtacgatctgggcatcgccgcctttaccatcaccaaggagcgcatggaatccgtcgacttcgtctcctacttcaccgcaggcatgggctatgcagtggccacaggcaaccccaagaacgtcgatgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccatcgcccagaccgatggtcagctggaacagctcggcaaggacttcgatgaagtgccgaacgccatcgccatcaaaaagggcgattcccagaccaccgaagccgtgcagaaggccatgcaaaagcttatggacgacggcacctacaccaagatcctccagcactggggcgtcgaatccggcgcactggacaaggccgaaatcaacccggccgtcgaatagccgacaagctgtcgcgaaaattcgaatggggcgcactgtttgtaacacagtcgccccattcgtacactaaggttcaacgctagttgcaacttgcagttcaggctgcccaacacgtccaaggaaccaaattatggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccatacgatccgccgtaccccggcaagtctgacggcgagccgaaggacgatgtgaacaaaatcaatcagaccaccttcgctgggctgaatgcgtaaggcgggagcgagaattatgactacgaacgacatcaccaactccgctccggtcgtgcgcaaggcggttgacggttccgtgattcctgctgtcaaggccgtgcaggtgcacaaggcgtttgggccgctgcatgtgctcaagggcatcgatctaaccgttatgcccggcactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgttctcgcctcggcatggtgttccagcgcttcaacctgttcccgcacatgaccgcgctggaaaacgtgatggaagccccgattcacgtgcagcaccagtccaagaaagccgcccgtgacctggccgtggccgagcttcagcgcgtcggtctgggcgatcgcatggactattacccctcccagctgtcaggtggtcagcagcagcgtgtggccattgcccgtgctctggccatgaagccggagatcatgcttttcgatgagccgacctccgcccttgaccccgaactggtgggtgaagtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcctacagcacgtgctgtaggaaggctgttatattgcctcagcactgtcgtgcttcggcgtcgcctacggggagcccactgggctccccgctttacggctccgcctacagcacgtgctgtaggaaggctcgttgttgcagctccaaaagcgtacgctgatgaactcagcgtacggttttcacgaaggggcatgttccaatcctgcaaaggcggcgggttggattcgctttgcgcaataatcgtccgctaggctggtgagccatgtgtggaatcgttggatacgcgggaaatattgaaacggcatgcggcaagcctttggaggtctgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgcaagccgatgccgctcgccacggtgggcatcggccacacgcgctgggccaccaatggcgagccgagcgacgtgaatgcccacccgcacaccagcatggacggcaaggtggccatcatccataacggcatcatcgaaaacgcctctcagctgcgtttcgacctgcaagccgaaggctaccgattcgcctccgccaccgacactgaggtggccgctaagctgctcggcaagatcgtggacaagattatcgcggacgaaggcaagccagacttgttcaaggctgtgcgccgtatggcccgcatgcttgaaggcgcgttcaccattctggccaccgactgccgccagccggacatcgtggtcggagcccgccatgattcgccactggtcgtgggccttggcgagggggagaacttcctcggttccgacgtcgccgcattcgtggcctacaccaagcgcgccatggaagtcgaccaggatcaggccgtatgcgtgtccgccgacaaggtcatcgtcgccgatttcaacggcaacgtggtcgaaaacccgaagacctacaccgtggattgggatgcttcggccgccgaaaagggcggctgggattcctttatggacaaggagattcacgaagaccctgccgcagtgcagcgcaccctgcttggccgcttcgacacgaatggcgacatcacccttgatgaagtgcgtatcgacgaacacgacttcaaggccatcgacaaaatcatcgtcgtggcctgtggcaccgccagctacgccggccaggtagccaaatacgccatcgaacactgggtgcgtatccccgtggaaatcgaactcgcgcacgaattccgttaccgtgacccgattctgaccccgcgtacgctcgtggtggccatttctcagtccggcgaaaccatggatacgctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgttcgtggcgcagattaccgccgcctacctgctgggcctgtatctggcgcaggtcaagggcgcgatgttccgcgatgagattcatcagatgctcgactccctgaaagacatgccgcgcaagattcagtgggtgctcgacacccagcccaagaccatccaggcggccgccgagcgcatggtgaacgccaactccttcttgttcctcggccgccacgtgggctacccggtggcgcttgagggcgcgttgaagctcaaggaaatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccacgcggcatgtggtatcggcagaccgcgctgatccgattgcgtgagcggctgggggagccggacatcacgccagcgcatcgattggaccgcatgaccgccggcgtattggtgttcgtgcgggatccggcctgccgcggcgcgtatcagatgctgttccagaaccggcaggccgtcaaggtctatgaatgcctggcgccctgccggccgatcagccgcccgcgattcggcacgatcatgaaggtcgagccgccatgcccgttcccattgctgcgccgatcgcacatcaccaaggaacatggcacgatggccgcattcgaggaaccgggtttggccaacgccgaaaccctcatcgagcgcggcgacctctgtttccctcccgctgacgggaggtggcgcgaagcgccggagggtggtccccatctggggaatcaccccatctgccgctacacactccacccgcgcaccggcaaaacccaccaattgcgtgtccacatgaattcgctcggcctgcccatcgtgggcgacgacttctacccgcgcatccagacgcgcccctacgacgatttcagccaaccattgcagttggtagcacgcatgctgcgattcaccgatccaataacaggcgagaagcgcgaattcgtttcccgtgtgccgcttaagatctgatttcttatgcattgagagtgttttcgctcatggtgtcaccattcatagagttcggcgggctgcggggttttgcggacatccagcgacaagccaagctcagtcagagcgctgagaatggtggagaatccgggattggggactcgggcgtgttcaaattcgatcagccagcgacgtgacacgcccagccgttgggccatgtcggtctgactgatgccctggcgttgcctttcatccttgataagccgcgcgtattcggcgatatccatgacaatcatgtgcaaaatatatcacagtatagtaaagtgtgcaatattctgcacatagttggaaatgtgcagaatattgcacaaccgagtcgattggtcggtgcggaattgcctatggatcactggcaggtgaatcactgacaggtaccagtggatgccagcgcatgccgctcgtcagctgatgtcgagcacggaaccgcgttcaatcagttccggcgggattacggttttgacgccgaccggtatcttctcgccttcgcattgacggcggaccatggagaaggcggtggcgccaatgtcgtcaaagcgcagcttcatggtcgtcaggttcaagcgcgggaccatatcgaccagcgaatcatcgacgcccacgatgctgacatcctcgggcacgcgcttgcccgctgactgcaacccgagcattgcgccgtatgccatttggtcgttggcggcgtagatggccgtgcagtcggggtcgtgggccaacgccacgccggcctggtagcctgaatccgcgcaccaatcgccgatgtacatgctcggtatgcgtgctcccatttgttccaacgcttctcgccaaccgcgggcgcggctttcggcggcgcgcgaggtggacggtccggcaatgtggtagacggtcttgtgccccttgctcatcaggtaatcgacgatagcggtcgagcagccatactggtcggcgtcaacggtggggcagtggtcggcggcggattcgcagatgagcacgactggaaattctcgcggaggcttgtatccgacgaaatcggagatgcgttcctccagcactacgatgacaccatccaccggctgacgctgcatgcgatcgatggcggcggaaagcgtgcgttccgcaccgtggcgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatacccaaggcgttccattgcggcttcgacacgctggcgtgttgcgggtttcaccgcatcgctgccattcgccacgcgggacactgtctgtggcgaaacgccggcggctttcgctatgtcttgcatggacacctgtgttggcctcgacatttcaccctcgcttgactcattaatgtcggtgtttcgtttgcaacgcttatcttagggtcgcttacggtaacgataacatcgttgtcttcgtgaccattgtagcagagtgactgagaaacccttaattcaacacggtactcaacacgattggacaatgttacaaatggtgttatgatgataacgcaaacattttggtcaaccttcgaaggagaggggttgggaatggcttcagccgatatcgcagctgcgcccgtgcattcgggcaaggctcgtgtgaataagcacaaggccgattggcgtggatggaaattcatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgtgcctgtcggctttgatggccctggcgttggattcgatgaagctgcatggcacgaggttcttccgtatctcgacgttcctgccctacgcggtgccggcggtggtgtcgacgttgatctggggtttcgtgtatggcgcgaagtacggcctggtgggttcgttgaacgatttcctgggcacggacatcgacgtgctcgccccttccgtgttgttggccagcatcgggaacatcgtgacgtgggagttcacgggctacaacatgctcatcttctacagctcgctgtcgaccatcccgcattccctgtatgaggcggcgagcatcgacggcgcgtcggagtggcagatcgtgaagagcatcaagcttcccgaattgcgcggcagcctggctatcacggtgatcttcagcatcatcggctcgttccagttgttcaacgagccgagcattttgcagaacatggttcctggtaatgcgatcacgacgtattacacgccgaacatgtacgcgtacaacctgagcttcagcggcaaccagtcgaattatgcggccgcgttggcgatcgtgatggccgtgatcaccatggccatcgcctacatcgtccagttgaacagcctgaaggagcagatgaagtgacgatgaccgctgttcgtgttgaggaatcgatgatgatcgtgaaggagcgtatgtgatgagtgcagcaacgacttcggccgccggtcgcctgaccgacgccgagctcaaggcccaggagaaggccgccaggaaggcggagaaggcccgccagaagaggatcgccgccgacgaggccgccgaacgcaagcgcagcgcgaaggccgggttcgcgaacgtgaacaacccgaggcgttccacgttgttgaccgtcctgtgcgcggtcttcgccgtgtactgcctgttcccgttcgtgtacctgctgatcaacgcgacgaagacacaggccgacttcacgagcacgttcggcctggggttcggcaagacgttcgctttgttcgacaacatcgcgaccgtgttctcctatcaggacgggatcttcgcgcgctggctgttcaacacgatcctgtacgtggtggtcggcgccggcggcgcgaccctgctggcgatcatgggcggctacgctctggccaagttccgcttcccggggcgcaaagcggtgttcgtggtcatcatcggcgcgatcagcgtgccgggcatcgctttggcggttccccagttcctcctgttcgccaaattgggcctgacgaacaccccgtgggccatgatcatcccgtcgctgatcagcccgttcggtttgtacctgatgtggatcttcagcgagcaggccgtgccccaggagctgctggaggcggcgcgcgtggacggcgcgtccgagttccgcacgttctggcagatcagcctcccgttgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcgagcacggccggcggccaggcgatccagaacctggtgatcacgggctccctgatcacgatcatccccttggtcatcgcgttcttgtgcctgcagaagtactggcagtccggcctggccgcaggcgccgtcaaggagtgagcgtactttggctcccttctggtggagggagccgagataaaggcataaccactaacagaaggaggcacctatgcagatattcgcattgttgagaattgtgcaggtgcctccttgtatgtctgtgcaacgtgaggaatttattcccgtagacgcagattatcgataaaattcaataaaggaactgaatcatcatggaacgtaaagagttcaagtggccgcagcctcttgcgggcaacgagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgccgtcaacgacgcctggggcaccgccttctgggcgcagcgcatgaacaatttctccgagatcatcccgccgcgcttcatcggcgatggcaacttcatgaatccgggcaaactgcttgactggaagcgcttcagctccgacgccctgctcgacttttacaaggccgagcgcgatgccctgctcgagatcgcccccaagccgcagaccaccaacttcatggtctccgccggcggtaccggcatcgattacgacaagtggggttacgacgtggacttcgtgtccaacgatcactacttcacgcctggcgaagcccacttcgacgagctggcttactcggcctccctgtgcgacggcatcgcccgcaagaatccgtggttcctcatggagcactccagctccgccgtcaattggcgcccgatcaactatcgcgtcgaacccggcgaattggtgcgcgactccctggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtgcgccattggaccgagccgctcgcgtggttccgcgcgctggcggacaacggtctgaccgcagacgtggtgccggttcgcggcccttgggacgagtacgaagccgtcgtgctgccgagcctgaccatcctgtctgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggcgtgcgcgttgaggaattcgccccgatgggaaacgacttccccggtgccatggaccaccttgacttggacaacggaaccgtggcgcacgatttcgccgacgtgatcacctccgtggccgataccgctcacgtggtcgcctccttcaaggcagataagtggaccggtttcgacggcgctcccgccatcaccgtcaacgacttcggcgacggcaaggccgcatacgtcggtgcccgtctcggccgtgagggtttggccaagagcctgcccgtgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggcgaaccgctggtcgcctcgctggcccaggtcaacgagtccgagcacacggccgccatccagcccaacggcgtacttgtcgtcaagctgtaaaaccgcgcatagcgcctaattacccaacggctcccttgctgctcatcgtagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggtcattcccgatctgcggcaggtgtacttctccgaactcgccgaggatattctggccgaggcccggcaacatggctacggcgtcatcgtggaatccaccaccaacaatcgtgcccgcgagctggaaagcatcgcatcgatgggcacgcacagcgcggacgggctcatcttaagccctctgatgatgacggttgacgatatcgcggctttggatggcgattacccgctcgtgctgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcaccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgccgagcggttgcggcgtgacggcttcgggcgcttcggcggtgttggtgcggtacggatcgtcctcatgcaacagttgcgccttgccgagcgcgagcgtgccgagaccgggcaggccgggcagcccggaaaggtcgatggtgagcgtgtgtggggtgttggcgtcgcggttgacggcaagcagcagaccggtgcgggcctgttcatcccacgtgactaccgcgtcgatggccggcacgtcgccgtatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgtggagacttgggccatggctcgtggtgcaaaccctgcgcggcctccgccttccactggtcttcctgctcgttccacttgtccgaataccatacgccccattcgtcgaaggacagggcgatgtctttggtgccgttgttggcttcgcgcgcctgatcggccgcgtccgagacggtggcgatgaacttggtcatgtcttcggaagaggccaggaagtcctgcatggaggcggcggcccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcatggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccagttgtggagacgttactggccgtggtgccggcggcggtcggcaccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaaggcttggaacaaaacgccaagtcccgtcgtttcccataacaaggaaggaaagaacgatgaagttcggcaagaagacgattgccctgattggtgctgtggccatgctctcctctgtagctgcctgcggttccacttctgccggggatggcggaagcaccggctcctctgataagaaggtcgagctgaccgtgtggtcctgggattccacactgcctcgtacggtcaagggattcgaggccaagaacccgaacattaaggtgaaggtgaccaacgccggcaccaacaaggacgagtacaacgcactgtccaacgccatcgaggccggctccggtgctccggacatcgcccagatcgaatactacgcactgcccgaatacgtgattcgcggccacctcgagaacctctccgatctcggcgcctccgatttcaaggacttctacaccccgggcacgtggtcctcggtgagcatcaatgacggcgtctacgccctgccgatggattccggcccgatggcctggttctacaacaaggacgtcttcgacaaggccggcgtcgatccgacccaggtgcgcacgtgggacgacttctacgaggccgccaagaagattcgcgccgtggactcctacatcacctccgattccggtgacgccggcttcttcgactccatgacctggctggccggcgcgaccccgttcgagacctccaaggacggcgagaccgtgaccatcaacctgaccggtgacaagaacgtcaagaccttcaccgacttctggcagaagatgatcgacgaagacctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggtcatcgtgaagtccgacgacaaggccaaggtcgccgccgcctacaagttcatggaatacgcctgccacgacgccgagggcattaagacccgtgttgacggcggtgccttcccggccgacaacgacaccctcaagtccaacgacttcctcaacatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcacagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccctggcctcgtgcgggcaggccacggacgacaaccgtacggagatcagcgtatggagctgggaaccgagcatgggggaggtcatccgccgtttcgaaaaagccaatccggacatccgcgtgaaatggaccaatatctccggctacggcaatcttaataccgccattcaagacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctatggactgcccatggattcgggcccgatgggcttcttctacaacgaagacgtgttccgccaagccggcgtggacgccaccaagatcaagacttgggatgactattacgaggccgccgaaaagctcaaggagatcggcgcgtatatcgtcgccgactcgggcgacggcagtttctatgacgcgatggtctggctcgccggtggtcagccgttccacacgtcggccgacggcaaaaccgtgaccatcgatttggatgaggatgccggcacccaacggttcaccgaattctggcagaaaatgatcgatgaggggcttgttgacaccacctccgccacatggtcggatcggtggaaaagcagagtgggcaccggcaccatcgcctccgtgttctccggagcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcttatcgtttcgtggactttgtggcgcatgacgcccaaggcattagcgcgcgtgtggatggcggtgccttcccggccgattacgccaccctgaattccgctgattttctggataaaaccacgattaccaatgaccggggcattgaaatcccgtatttcggcgggcagaagttcaaccgtgtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcctcaatcagggctttacgattaagtagggattcggggttggatcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggcatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggttttcgcagcattgcgcattctgcctggcgatgtggcctccgtgatggccggcgtcaactcgccgcctgagcgtgtgacccagctacgcgaacaactcggtctggatcggccattgattgcacaatacttcgattggatgagtgcgctggcccgtggtgacttcggcacttcaatcctgactggtcgctccgtaacctccttggtaggcgcacgtgcgtccatcacctttcccctgattattcttggcctgctcatcgccttggccatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgacgtgtttccctcgcaagggttcccgctggatggctggggcgcacccggttcggcgatatcagcgttggtattgccggctgtatcggtcggcatcatcgtgggagcatcgcttatgcgatacacgcgcgcggtcttaggggatttagccagttccggctacatcgatatggcacgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgctccaccgcgtgctcgacccgcgtctgaaaaccgctaccgccattacggaggtgaccgcatgagcaatgttcgtcgtgcgacgactggtggtcgacgggctgccttcgtcatcgtcctgcactccatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcgcgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcgtcccgctcgtcatatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggctgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcggcacggaaattatcggagcttccgaacgtgcgcttgccgacctgcgcggccggtatgtgggtacggtattccagaatccggtccatgcgctgaacccggtgatgaccgtggcgcagcagattgcgttgccattgagactgcactacgatctgaccaaggccgaacgtgctgagcgagtgaataccatgctggacaaggtcggactggaccgtgacgtggccggcacatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccactcctctccgcccactccatcaccaaatccttcggaccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcgaccctgcgccgcgaatcgggactggtgttccaggacccgttctcatcactcgacccgcgttggcaagtcgccaaatcggtggctgaaccgctgagtctgcagcgacgtgatctgaacaacaccgatatcgacgagcgggtggtcgcggctctgaccatggcgggtcttgaaccggcggacttcctgaaccggtacccaatcgacctgtctggtggccaggcgcagcgcgtggtcatcgcccgcgccatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtgcagcacatcgccaaccgcatcctcgtgcttcacgacgggcgcgtcgaagagacgggtcccaccgccgaagtgctcggcaacccccaatccgattacacccgtcagctcatcgaggcagcctcgttatagacctttttggctcccctctctgaggggagccggccgccggcgacacgcgcttgtcgcgggttgtgctatggtgtgaggcatgcagattatctcatgttgttgtcgctaaccgacgcccctgggcgagcggtcagtgacgcataacttgagatagagcattcgaatcgcggcgaatctgccgcatacttttcatgtatccgatggcacgagcgtaaccgtgtaacgcgcgagtcgtggttaacatgaaaaaccgattcacttttcggattcaccgtacagtgagcgggaatactcgattttcaaaccaaagccacagtccattcgtctgggaacgtcggttcacgaacgcaacgcagcaaaacccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggccgtggccagcgccatcaagtacgcgcttgccaatgatttggacgagaaccagatcgtggtggtgctcgcccctgattccggccgcagctacttggagaagatcttcaacgacgactggatgcgtgtcaacggctacggcgacatcgtggagcgcaccagcaagccctccctcgccgagcagtaccttaacggagctccctctgatgagggagctggggacggactccataactagctatcaaaagaatcaataccaacatccgcactaaccaaccgcacctgttctaccttcgaatacggaacgatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccaccgaagtcgcccacaagtacggcaccaaggtcgctgtcgacaacaccttcgcctcgcccgcccttcagcacccgctggccgatggcgccgatgtggtggtctactccaccaccaagtacatcggcggccactccgacgtggtcggcggtgccgtggtggtcaacgatgaggagacccgcgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggcgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgcatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatattgaatcagctggcgttgccgccctgccatccagtggcatccgcaccagccgggcgcaacgtctgaccggaagtcggtgtggtgccatcaacgaccacacgagtgccgatggtggcaaagtcgtacatccacttggcatcggccacctgcatgttgatgcagccgtgcgagcctgggataccctgctgcacatagatggggtgctcgccccacatgtatgcaggaacaccgtgcagagcctcgccgccgttatagtaggaaacccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatttgccgtatcgaagttatgaggcacctcgacctgcttgacatcatacgggctgtctttcacagccacagtggaatcagtggactggttctgctcgatggcggtagccagacgttcgggggcgtccccggcgccagtcacttcaataccatccacgccgagtgtcttatcggcaccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccttccgccttattcaccgtgggcttgaggaatgaggcaatggtatcggccgggatggtgacgctcttgttcacgccgttgtctacggtcagtttgaggccaagcctggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccgggcccttgccgtcctgacccgcggtgtagtcgaactgtttggtgctcttgttgtagacaacggtggcaatctgcgctcggtcggcctcatcgaccaggccggcggtgacgaattgttcggcagtctctttgtccgtggtggcggtcagagcgatatgcggctgatcgaaaatattgagcttggccacgtcgccggtcttcgcgttcaacagcgcatccacggttttatccgtgtcgacggtgacgccaaggtccttcagcgaggctttgacgctgttgccttcggcggtgaacgtcaccgtggtgttattcagccgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgctgaaatccagccgcggtcggcctacactggtcgtttatgacagcacatcaggcggcgctggaggcgctcacacgatacttcggctatgactcgtttaagcccggacagcaaggaattgtcgaggctttgcttgccggacgcgatgtcttgggcgtgatgcccaccggcgcaggcaagtccgtgtgctaccagattcccgccgcgctcagcccgggtatgactttggtcatatctcccttgatttccctgatgcgcgaccaggtcgatgcgctgaacgacctcggtctgccggccgcgttcatcaataccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgccgggacatcgtgggactgctgggattgcggaatccggccgtcaccgttaccggattcgaccggccgaacctgtattttgatgtggtcaaactggaaaccaaatacaaggccgcatgggtggcgcggtatgtggccgaccatccggacgaatccggcatcgtctactgcgccacccgcaagaccaccgaagcgctcaccgacacgctgaaccagatggggcatccggccgttgcctaccatggcggcatgtcgccggacgcgcgtgaggcggcccagcgcgacttcatcaccgacaaggtgccggtggtcgtggccaccaacgctttcggcatgggcatcgataagtccaacgtgcgttacgtcatccaccacaatctgcccgaatccattgaggcctactatcaggaggccggccgcgcgggccgtgacggcgagcccagccgatgcacgctgctgtggaatgagtcagacatcgtcacccggcgtcggttgctggataacgattatgagaacgaacgattgactcccgaagagcaggaaatcgttcgccagtccaagcgccggctgctggacggtatggtcggctactgccgcaccaccgactgcctgcaccggtatatgacccggtatttcggtcaggaattgtcgccgaatgctggttccacggcgggtgaagacattgcggcggactcttcgcagtccggcaaatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaggctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggcggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaagccatcgcctcgttcaatgccgggagtgcgtcataacaatctcctatagcgaactgcggagtatttgcgggcgttcttgggctggctcgactacgatgactgttcgatgcttcatgaccgaacactcggcaagtagaaaggcaacagcatggcagaagacaaggccgaaaagcccgtcgtcgaatcattccagcttgatcacaccaaggtcaaggcgccgtacgtgcgttacatcgacaccgaaacgggccctcacggcgacgtgatctccaattacgatctgcgcctgacccagccgaacgagcaggccatccccaccggcggcctgcacaccatcgaacacaccatcgccgtgctgctgcgtgaacgcattcccggctacatcgactgctcgccgttcggctgccgcaccggcttccacctgctgacctggggcacccactccaccgaggatgtggccaaggcgttgaaggaatcgttggaattcatcgcatacaaggccacatgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcttggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcgatgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgtcgccagcgtgttcggttccgcggtggagctggtcaggtaaggtccacgtcgtcgcgcacgtacggtccgtcggccgcccgttcaaactcgtgcatatcgcaaaaaccgtacgctgaaagtaactcagcgtacggttttcacgaaagcagccatcggctatcggtcagccgatagacctcagtcctcagtcctcagtcgcagcgaccttggcgtcagccccggccttctgctcaaggccgagcttggagcgcttgcggctgtagccgaagtacacgatcaggcccagaccgaaccagacggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtacggtacttctcgtgcacgtggccgaagaacttcgggaacaggccgtcacggctcatggcgtagcagatacgggattggccgtacagctgcacgagcatcaccgtggtcatgccgatgagggcgcccaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatggagagcacccacgtgatgatgagcacgatgacgaaaccgggcaggttgaagtaggtggtgacgtccgggttggtgccgtaggcggcggtcagctcgaccggcaggtgcaggccgaagccttccagcagtttgttgaagtagcccgaccagccggcggacactgtggccgcctgcagggcgtactccagaatcagatcccagccgatcacgaaggcgatgagctcgccgaacgccagataggcataggagtaggccgagccggaaaccggcgccatggcggcgaactcggcgtagcacaggccggcaaaaccgcagcagacggcggccagcaggaacgatacggacaaggccgggccggcggtcagcgcgcccttaccggtgagcacgaagataccagtgccgatgatcgcgccgatgccgagcatcgtcagatcgaaggtgcgcatcgtgcgcttgaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggtttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcggggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgctgccatattttgacttgggtatacaacggcaccgaagtcccgttcgacgagctgatcgccgccgacatcgacgtatcggtcggctccctgcccggcatcgacgcggtggccgccgccgcacgcaagctcggcaagcccgcccgcgtacacgtcaaggtcgattccggcttcggtcgcaacggtttcacaccggccggattcgacgccgcgctcgccaaactcgtgccgctcgccaaagagggcgtgttgcatattgtgggtcagtggagccatctcgccgtggccgattcgcccgatgtgtccgaattcgtgtcctccaccgaccgccagatcgaaacattcaaggacttcacgcgccgcatggaacaggccggcattccgccggagatccgtcacctggccaacacagcggccactttggaccgcccggagattcacttcgaactcacccgccccggcatcggcctgtacggctacgagcccgatcccgcgatgggcaccccgcgcgactggcatctgaccccggccatgcgcctgcaggcgcagctcggcacggtcaaggatgtggaggccggccacggcatctcctacggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccaccgaaggcccgaagatctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtgctgcccgccgccgacctcgccaaactcgaccccgccacgctgctataaggtgcattaacgccatacggtggcaccccgtaatcccttcttcccgaatatgtgccactgatatgtgctgagcgtcacatattcgggaaatcggccccaatctcccgaatatgtgccgttgagttgacgtcagtggcacatattcgggaagtcgggattactgcggccgatatgtgtgcctatgcttggcatatggaaacgactttggatggggaacaggtgctgagcgacgagggctacagcgccttcgacgaggagcgatgggcacccgagccgcccaaatccaagtcacgcaccgcgttcgagcgcgatcgcgcgcgactgattcattcgtccgctttgcggcgtttgggcgcgaaaagccagattctgattgccggtaccgacgatttcgctcgcactcgactgacgcatacgctggaagtcgcccagatcggtcgccaaatcggcgcattgctcggctgtgatccggacgtggtcgactgcgcctgtctggcccacgaccttggtcacccgccgttcgggcacaatggggagcgtgcgctcgccgacatcgccggcaatatcggcggcttcgaaggcaacgcacagaccatgcgtatcctgacccggctcgaacccaagatctttcacccggacgggcgttcggccggcgtgaacctgacccgtgcggccttggacgcggccgtcaaatacccgtggaccttggccgaagccgaccaacacccaaagggggagcggtcgaagaaattctgcgtctacccggatgacgagccggtattccgatggctcaagatcggcgcgcctcaggctaccaagcccatggaatgccagatcatggacctttcggatgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagtatttgttccctgcatatttcaatggttcgcgcgaatcgttggcacagcttaagaacattacgtccgatttgatcggccgcttctgctggtcggtggaaaccgccacgcgcgacacgtacgggcccgggccgttgacccggtattccgcgaacatcgtgattcccgagaacacgaattacgagatcgtggcgctgaagggcatcgccgtgtacttcgtcatggcgcctcgcgagcgcgagccattccatcaggaggagctcaagatcgtatcggatttggtcgatgtgcttatggctgattcgccgctcccatccgacgctttggaaagccagttcctggccgattggaacgaatccaccaacgacgacgaacgcctgcgcgtcgccatcgatcaggtcgcgagcctgaccgacaactccgccctagccctgcactccatcttgtgctgagggcgtgttgggcgggcgcttccctcagtctcgctgcgcgagccagctcccctcgggtgaggggagctgtcgctgtagacgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgccacttggcctccaagggatttacgcagaaggaaatcctcgacgcgggcttggcccgtcaaggccagcgcggcatctatgactatttccgcggccgagtgacctggcccatccgcgattcgaccggccgcacgctcggcttcggcgcgcgcaagctgtatgaggacgaccagatcgccgccaaatacatcaacacgccggatacgcagctctaccgcaaaacccaggtgctttacggcatcgatttggccaaatccgccatcgtcaagaagcggcaggtggtgatcgtcgaaggctatacggacgtgatggccatgcacttggccggcatcgacaccgccatcgccacgtgcggcacggcgttcggcgccgagcacgccaagattgtgcgccgcctgatcgccgacgattcgctgggtgcggtccagctggtcgggccgttgaaggtcaaggaccagccgttgagctcgcgcatcgtgttcacgttcgatggtgacgccgccggccagaaagccgcgctgcacgctttcggcctcgattcggccttcctctcccaaaccttcgtggccgtggccgacgacaatctcgacccgtgcgacctgcgcatcgagcgaggcaacgaagcagtgcgctcgctgatcgcccgcgccaaaccgttgtatgacttcgtgattgacgccgccatcagccggttcgatctgacctacacgcccggccaagtgggtgcgatgaaagccgtggccccgctggtggcgcagattcgcgaccgctccctatgggacgcttacgcgcgcaagtccgcgggccgtatcggcgtggaccttgaggtgatgcgccgcgaggtgatgaacgcacgccggcagatgcacgtgcgcgatgaggacgcctacgcgcccaaacatcgattcgagcgtgacgagccgcgtgtggaacccggcaccaacccatacgccaatccggccacgcgcaaggccttggagcgccgtgacgccgccgaacaggcatatttcaagatcgacgacgccgtattcatcgccgagcagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaacctcaccaaggccggcggaccgatgctgaatcaggtgatcaacgagctggccgtcatgccgttgccactgcctggcgacgacggtggtaatggcgcacaacctccgcagtcgaacgtgcctgggggagtcggcggtggtgcggccgccgtgcagctacgccctgccacgccggaagagcagcgctatgccaccgaactgctcacccgattgttggacatgggcttcatgcgccagatcggtttggccaaacgccgcatggctcagctgcccgacggcgaagagaagataaccctcctcggccagatcacccgcatggaaaccgcccgtaaagacctccaagcccaaatctacggcaacaccgttggctagtaatctctccctctgacgagggaggttactggccgcagtcgggcggggcgagagaagcgacgtcagatatatcgcgcagcatcgatgtcacatcaactattcgtttgatattaactttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggagagtgacgggagtcgaagccggagaggacaacatggttgtagctgttgaatacatttccaaagaagaatccgcagacgccgaaaccgccacgcacggcgtgaccggtattctggccgtgcagggcgcgttcgccgaacatgcggcggtgctcgacaaactcggcgccccgtggaagctgttgcgcgcggccgaggatttcgatgaatccatcgaccgggtcatcctgcctggcggtgaatccaccacgcaaggcaaactcctgcgttccaccggcctgttcgagccgatcgccgcccacatcaaggccggcaaaccggtgcttggcacctgcgctggcatgattctgctggccaagaagctcgacaatgatgagaacgtctacttcggcgcgctcgacgctgtagtgcgccgcaatgcttacggtcgtcagctcggcagcttccaagccatcgctgatttcggccaagccgacgacccacagcgcatcgcggactttccgctggtgttcatccgtggaccctacgtggtgtcggtcggccccgaggctacggtcgaaaccgaagtcgatggtcacgtggtgggcctgcgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccgtggtcggtgttgttctccgactattccaaccgattcacctaccacgacattgcctcggccgagcgggcgcaacgcggcgataccatcatcgactttgccaccggctcgcctaatccggcggatatcccggacgatctgctgcgcaaggtcagcatcgaagcattcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgcgcgttcatcaaccccggcgactgcgtgctggtcgaacaatccacgttcttcccggcattgcagaccttccgttcggcggatgcgcgcatcatcggcgttccagtggacgagcacggtatgcgtacagacctgttggatgggtattgcgcgcgattccggcccaagctcatttacaccgtcccgacgttccaaaaccctaccggtaccacgctgtcgcccgaacgacgcagcgaactcattgacgtggcgcggcgctatcagtgtctgatcgtggaagacgatgcttacggcgatttgtggtacggcggggaatcgtccgacgcgcatcgccccataccgcttaaaggcatggagaatgcgggatacgtgatgtatttgtcgacgttctcgaaaaccgtcacttcgggcctgcgcacgggatgggttgtggccgatccgcatgtgatcaaccggctggcggctctgcggcgcatggtcgaccagcatacgagcacgtcatcgcagcgcatctgcctggaactgcttaaagaaggccgcatcgccgaacatttgcgcggtttgattaaggcttaccgcattcgacgagatgcagcaatcgcagcattggagcagtatgcgccggatgaagtgtattggaccgtgcctgcaggtggctactatatttgggtttctttgccggacggcgtgcgctctctggatgtattggaatcctgccgttcccaaggcgttacgttcatgccgggcagcgtgttcgacgttgacgaaatggatgattcccatattcgtctcaactttgtgcgcccggatgctgctgacattgataccggcattcgaatcattggcgagacgatagcgcagatgtagccaagtgactggctcattgcggttgtcgagtttttttgatggctacatacccacatcgatgggtgcattcgacgaataaataagcgaggaagccatcatcagttcgctgtggcatgcgcatagcgttgtcgggcgaacgggacagaccacgtggtcgttgcatgatctggtcgatcgagccggcatcgcattgcccctggcatagtggcgaggtggcgcagtaacgagtcacgccatcgcgagccgatgatgcgaaatacggaaccggtcgcggccatcaacgggtatcatacatgtggaagcaacgatacgttggcgtcagcacatccatctgacttcagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgcagaaatcgccgattggggcgtcgcgaccgaaagcaacgagtacttcatcaccgaacagcgtcgtcagtccttggccgaggctcagtccggtggcgatgagtgggagaagcatggcaccatcggcgccgtggcgcgcgatgccgaaggcaatatcgccgccggcacgtccactggcggcatcaccaaccagatgcacggtcgtgtaggcgattcgccgctgcccggttgcggcacgttcgccaaccagtccacggtggcggtgtcctgcaccggcatcggcgaggcattcatcaaggtggtcgccgcccatcaggtgtcggatcgtgtgcgtttcgccggcgagaacgtcgaggatgccgcgacggccactttggacgaagtcgccgcgcatcatggcgatggtggcatgatcgttctgccggcggtcggccgtggcgtggtcgcctacaacagcgagatgatgaacttcggataccgtagcgcgcaaggcggtaaggtgcagggctgattgccccctgtattgcggcatataacatgaatggccggtgtgctgcggattcttggtaaggaatccgcagcacaccggccattcatgtatgcggcgagtgccgccgatcggtgcggcagtgtgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggttttcgccgtcggactggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccggattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcgggggagtggtaagaatgttcgtcgacgataatcgcgtcaccggtggcggaatcatgtgccccggaatcggttgcggccaacgctcgcgcatggtcccagctgcgtttcatcgtcggctggaaggggaacagtccggcgctcatcacacacagcatatccgggtatcgttcgtgaatggcctcgctgatcatgtcaaacttggccacgtagtcagccccgaaattttcgttgcccacgccgatcatgtccaggccgaacggttctggatggcccatatcacgccggaccgcggcccacgagctggactccggatcgccattcgcgaattcgatgaggtccaggtagtcctgaatcacattgttgcggaaggtggccgaattgatatccatgtggtgcggatcgcggccgggcgactggcatgcgatgccggcgaacagagtaggcagcggcttggccttgaggtccctcgcacaggcagaaatactcgtagaagccgatctgatagctctgcgaatagctggaaccatccggcatcttgaacgaccacatcgaatactgttggcgtcgcgcggccagggagccgacggtatccttccagcgatattcattgccgggcgtcacaccttcgacgatgcagccgccggggaatcgcagaaacgctggatgcaacgcctgaatggtttccaccagatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcaggccggttacgtcggcgttgaaccggtaccagccgtcacggccgatggcgatggcaccatccgacgaatccggactgatcgaaacgccggaatcctgcgcattggcaccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggctggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtggcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccggctatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgtcgctgtatcgagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgaccctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcacggcggcgtgagaatcggcggcgtacccgtcagcaaactcgacgagcgtgagctggcggccttccgccagaagcatctcggcttcgtgttccagtcgtacaacctgctgcccaatctgaccgcgctcgaaaacgtggcaatgccgctgatgttccgcggcgtgcccaaggaacagcgcgaacgtgcggcgcgtggcgtgctcacaagggtcggtctgggacatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgtgcattcgcccatgacttcaaccagaccatcgtgctggtcacacacgatccgcagatggcctcatacgccgaccgcattgtcaccttgctcgatggccgcatcaccagcgatcggctcaacaccgacctttcccgcccaactgttccgtccacgccgtccgccccaaccacaccaactacaccgtccacgccgtccgcccatagaacccaaggaactgaccgatgaagcacctctcccaccacaccatcgccatcatcgtcgcgttgctctccacgctgtcactggcacttgccgtcatctcccttccgcatcaggcgtacgcggtcgacggcacagacggcacaagcggcacgaacagtacgtctcagggaagcgacggcgattccgcgccgatcgccggaccggtgcccaacatcatcatcaccaacttcgcgtatggaggtgattccgtggccgccggatccaaattcaatctcgacttcaccttccagaacaaggggcaggtggcggtgacgaacatggtcgtcaccgtggacggcggtgagagcttcgccatcgcgggaggcacgaacacgttctacgtcgacgcgctgtgggccggttacgccatgacgcaaagcgtgccgatgcaggcgctcgcctccgcgaaaagcggtgcccagtccgtgaccgtgaacttccgatacgagtatgtggacgccagcgcccgctcctcaagccagtctgacgtcaagatttccgtgccgatcagtcagcctgaccggttcgaaatcagtgatcccgtagtgcccgaccaggtgatcgccggccaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgccttcacgccgcacgcgtcaggcgagctgaagaccacgctcaaagtcacgtacgagaattccgacggacagaccaagaccaaggaattcccgctcgccatacccgtaaccgatatgcagccgatggatgattccggcatggccgatccgaacatggaacagaacgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctattgcaccagcctcaccagcctcaccggccggcccgtcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagcttgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagctcgaccagatgggctacaagctcgtcggtggcgagaagccggtcaaaaaagaccaggtgcttgccggcgaatggttcgcctatggtttcatggacaccctgaagaacggcgaacaacgcaccagcacacgcggcggtcagtattcctcatgcacgtttgaccagaccacaggccagtgcgaggaagatcaggacgaggatccgttcttcgacccgctcgccacgcaaatcagtctgaccaccggcaccaattatcagggcgaccagtacaccatgaacatgtacggcggcggtggcggcacaggcggtgcgggtggcggtggcggcgcgggcggcgcaagcggcagcgccgcgggtcagtcggaaaacgtcaccctcgatgtgctggcttccggcattgtggcgggcgactacaacaagggctatgccacctccgacggtctggtcatggatttgcaggcgttgaaggaactggccgccaaagtcgatccagccgccgccaaaaaagccaccgcctatgatcaagtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggcgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggatcgatcggctgcgtgctgagcggactgatatcgctgggcatcaacgttgtcggcgcgttgtatgcgggcggcatgagcggcggcatgtctggcggtatggtcagcggtgccggcgggggctccggcgacggtaccggtggcggaacatctatctggaccatactctggcaggcgatagttggtggcgagaatgtgacccgttattcggtgattccgtggtggctgttcctgttcgccgtgctgttttccacgctgatcggcttgctattcggcttcggcccggccaataaagccgttaaaatcccggccctagacgccatcaaaaacaacgagtgatcgcctctgtcacctgctccaccgttagtccataacgttcgttcagttcgcccagcgacacgcggtcggtaaattccttggctgcgccgaagttcagcacacgaggattacggctgccgtccgagacatgatgattcgcatagtatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcgtcagacaatgcggcggccgtctgctccgccaacggatacgcattgcccagtccgatgatcgcgacttgcgagcccgtctgattgacccgccaatccagcatgtgacgcgcaccggcatgctgagccgttacgctaacggtcccgcggactgttgcggcagatatgcccccgctggcggagctggcggaggctggcagcgaagctgactgggggcggtcagcaatctgcccacccgtcaccggcagcagcgtcgcatcccgttccgccgccagaatcgcctcgcccggcacccgaatcaccgccggaccagcaggggcgtccgccgaaccggccggcgcggtagcccatgccaaatcagccagatagtcgcgagccgaagtcggcaccagcatcgtaacccctggaatattggagaacatcgccacgtcatacgcgccggaatgcgtattgtccgaaccggacaagccgcccagaaaatcaagtaccgtgactcgcgaacggttcaggctcatctcctggaagaactggtcgtaggcgcgctggaagaaggacgccgtggtggccaccaccggcgtgccacctgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcctggctcggcggcgaaacgcggttcgagcgcggccatcgccattttgccgtaatgcttgcgcggatcgtccggcttgccgattgcggcatccggattctgccaatgcgaggcctcgcactggccttcatgtggttcatgatcggacaggttgcagtgatccgaatgccacggttcgctgtggttcacgttatcggtgggatgcacgccggtgggggagtcgaacgaaaccggtgaggccgaggcggtttgccgatctgcgtgagtctcctcaccgtcatatcctgcgcccttcagcgtatgaatatggaccaccaccggatgatcgatatcgcgcacttcctcgaaagccgcgaccagcgcggaaacatcgttgccggcctccacataccggtaatccaagccaaacgcgttgaacaggttcggctgggcagtgccgccggatgcgcgcagacgggcgagcgggccgtacatgccgccgaaatcgccggcaatcgacatctcgttgtcgttgaacacgatgatgaggttgccgccttgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgcccggattggtgaagccggtcacctcgctgaaacggtccgggtccagataggcggcggcgcggcccgtgagcatcttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggcgcgaatctcacggcagagttcggcgagctcgttgggggcaagggccttgacatcggccgggctggcaatgcggctcagcagatgggagtcgtcgccgtgggaaggggtaatgctcgggggtatgtcgtgaaggcgcgtggtcctctcggcagcgccggagacggcgaaggaatcgcttgaatcaaatccgtttcctgacgcgctgcgcataccctcgaatctcccttcgctagtctttccgaagttgaatgctaacgcccggcattgtccgaggtccacatgacgaagcaatgcccccaacatctccgtaaatgggtgattcgttcgctgcgcgatgtgggacaatgaatgcggtaattcctttttgataccaaggagcgcgcaatgaaggccgtatacgcatccaccgtcaaccatgccgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggccggcagcgaagtggtgctgtacacgttcgtcggcaccgatggcgcgggcgtggccccgggcgagcgccgcacgatcctctccgagaaataccccggcacgatggccgagaagacttccgtgccgtccgccaacgtgttcgccaagcccgcaagcctcaccacggttgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaggtgttcgtcacctcgcgcgacgcggacaagcgctccaaggcgctgaaacttggcgcgaacgccgcgctggagatcggtgcccgcctgccgcgcaaggtcgatgcggtgatcgaatccgtgggcgcggctacttggagccattcgatgaaatccgtgcgccccggcggcaccatcgccatctgcggcgccaccaccggcgaccagcccggtgcggagctcacgcgactgttcttccaggacatccgtgtgcagggctgcaccatgggttcgcgcgaggatttcgcccggctgctgcgcttcgtggagcacgccgacctgcatccggtgatcgattccgtggtcagcgggctggacgccgcgcccgaggccttcgccaagatgattgccggtgacgtgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcggccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtgatcggcgtgcccgtgcgctcccacgccctgtccggctgggattcgctgctgtccatcgtgcagatgcccggcggcattccggtggccaccaccgccgtcggcaactctggtgccaccaacgccggcctgctcgccgtgcagatgctctccgccttcgagcccgaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactattgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgtcagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggcgaagcacagttcgtgcgcaatcgtctgagcctttggaccgcccggcatcccaaagcgatgcattggatgttgcagccggctgccggatggacaattgccgagcccaaaggcgtggtgctcatcatttcaccgtggaattatccggtgctgctggccttggaaccaatggctgatgcgctcgctgccggtaacgccgtctgcttgaaactgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggaaccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttacgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgactacgcccgccttgaacaggggagagagggccttgacgtagattttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagcggattggtggtgagctattcggcgtccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgataacgataacgcgcttgcctttaaccacgctgcgcacagcagagagcttcatacgcacaccctgctcgcgcagttcttgcgtgggctgaatgaaagtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggaatgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcgccttcctgaccgcgatgctgcagcgcgtgcaggccgaaataggtaagtcgggcggcgtcagggtggccccacacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtgattgtggtgtggggtgatgccggcgggtaggttggaggcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgttttttcggcttcgtctcagtgcctgaaatggctgaagaactcgatggtctcgggatcctgcgactcgtccatcacctcggcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggagtccttgacctgctcggactgcaccatgtacacgcattccacggtgctggtgaccagtacgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcgcctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgttgggaacattgagttgcacggtgtccctgttgacctgtggggtgaagtcgcttacctcgtccaaggcgatttcgttggcgatgccgccgatcactgcgagcgccgcaccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccactggtcgtttcctcggccactccaatgagattcgccgtgagttcggggcgttcgagcgaggcgaggcgggcgaagctggcgccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgctgtgcccgtcggtcatcgtggcatcttcgacggtcatgccccattgctgggcctgagacttgatttcggcatgcttctgcggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggcgcgcggactcgacccgttgaccacgcatctggtggtggccgatgaaacccgcaccgataagacaatatgtttggcggtctcaccctcgctgaagaactatggcattcccggtcgtgcgcggctattcgaggtaaaacagcgcctgaatggagtcaacatcgagcgcgcggtccatgctcccggcggccgattaatcggggagtcctgcgatgcatgcgacctggaacgctcgccgggactcaaagcctcgatggtcatcgccaaacctcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggtatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcagatatccgatcctatgagccaggtgcgcacagcattagcagtgggcaggtgctcaccggccccgccgactatgccacggcccggctgatcaccaaggagatggccgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcagcgaaaagctatcaagggccggtgaccatcgaccgatttgggcgcaaggtgcccaagagcgcggtcgggtcgattggtttgggtgatttcacctcgtcgtcggcacgtattcgtgaggccatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacgaggcccaatcgtatggatccgattccaccagcgaaaaagatggagagcatgatatccagcgtgcgctgctggatgtgaaacgtaaattcggccgcaacgccgtcatcaaagccatggatatggaagacggcgccaccggtcaggaccgcaaccgtcagatcggaggccatcgcgcatgaccctgcaagagacccatgcatacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttgcgcgggtactgcttcagcgtcttgccgaggaagcgttcggccgcgccgccagaataggcgtccgcgcagtcgaagaagttgacgccggaatcgtaggcgagtttcacggtctccttggccacatcctcggccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggtcggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcggccatcgatgtcctgcggattgcccagcaaaaacgggcagtgtgccaacgaagatagatcgcctgaagcaatggcgcgttcatttggaatcgtgttggggatggcggaatcgttggcaatattagtctggctgttcgcggttccggtggtgactaaatccagccataatgattgcgcaataaccagtaccatacgttcgtcgtagaatctcctgttatcttgagtcatggctcgtgcgaatagcgttgatgtttgcgactgcgggtcatgagatggaatctgagatgaggctgtagccagaagagggagaagatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccagaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcgaatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagtgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccatccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggttagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgatcttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgttcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcggcctcaccgtcgccggccaccacaatcgcatggcttgccgccaccgagccggccggaatcgtgagcgccacatgcttgggggtgatcggcaggccgagaatcgcgcgggcgtgcagcgcgaactcgctcagacgctgggaggccatcgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgtgcacgtcacaatgccggcggacgaagaaacagtcagtaccgtcagctcacgctccagcggggcaagcgcctcaacgatcacgcgcgacacatcgccctcatcggcggcgcgacggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcggattcggcgacgtgcgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggccctctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgctggcccgacgcatcgattggtggattgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggagctacgaaaaaacctccctctgatgagggaggtggcatcgcgaagcgatgacggagggagagattagcgaagggttttacaacaactcaataagctgatcgacctcttcatgcgtggtggcccagctggtgcagatgcgcatcacggtatgcgtgtcgtcggccttctcggtaaagccgagcttgacctcgcgctccagacggtcgatagtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcagtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttactggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgcccgggttctaaatagaagtgcaacaccttgtctaaggttggaagtgttcgaagtttctaacttaagaaggtgttgcactcatgggtcaacagtattcgcacctgtcccgaccagcaccaccaccccccgacccactcacccacaccaaacagcgaaaggccaaaaacgattatgtacgggcttcttagcctttgcgactatcgttaccgccttgccgagtaccgttgctcatgcagaaagaaagcagtattggacacaatcgaatgagcgtgtcggtatcgttgaaaaagtaatgaatgacggttctatcggttcaacctttaagggttgcaaccagttaacttaattgcttgctttcgattgttttcgtatgatatacttgagtcatgcgtgtcagggaatgggcgaggcgtgagggcttcaacgagcagacggtatggcagtggtgccgtgagaaccgcatgcccgtcccatttgagcgcatgagcacgggtacgataatcatccacgacccgaaatacgagagccaccccgtcgcccccacggcgaacggcaggacggtgtgttacgcgcgtgtcagctcgtctgaccagaaggacgatttgacacgtcaggccgaccggttgagggcgttcgccgtcaacatgggcgtcgagaagcccgaggtggtcacggagacgggttccggcatgaacgacaaacgacgcaagctcaaccggctgttggccgacccgaccgtcggcacgctgatcgtggagcatcgcgaccggctcgcccgtatgaacgcgggcttggtggagagcgcgttgaaggcgcagggcagacgcgtcgtcgtcgtggacgacacgggactcgacgacgatctggtgcgcgacatgaccgaggtgctgacctcgttctgcgcgagactgtacggacgccgcggggccaggcaccgtgcggagaaggcgttggaggcgatgcgcgatgagcgcgtatgaggccgtcagaatccggctcgacccgaccccacggcagacacggctgttggagtcccatgcgggtggcgcgcgtttcgcgtacaatctgatgctcgcgcacgtccggcgccaaatctccttgggtgagaaaccggactggacgttgtacgcgatgcgccgctggtggaacgagtggaaggacgaaatcgccccgtggtggcgggagaacagcaaggaggcgtacggcagcgcgttcgaatggctgtcccaggcgttgaggaactggtcggacagcaggaagggcaggcgcgcgggccgtagggtgggctggccgaaatacaagtcgaaacgctccagtgtcccgcgtttcgcatacacgaccggcagcttcggccttatcgaggacgacccgaaggcgttgagactgccacgcatcggacgcgtgcactgcatggagaacgccaccgaacgcgtccacggcagacgaatcgtgcgcatgaccgtcagtcgccatgcgggcttctggtatgcggccctcaccgtcgaacgtcccaccgaaagcgttccagcgaaaaacagaaaacggaagaaccatgatcgtcaggtcggcgtggatttgggcgtcaggaccctcgccaccctctcggatggcaccacgttccccaatccacgcaactacgtccgcacgcaacgaaaactccgccacgcccaacagtcgttgagccgccgcgacaggggcatgagccatggatgcgggtcgaaacggtacaacagggcgttggagcgtgtgcgccgaatccacgcccgcatagccgcccaacgagccgacaacatcggcaagctcaccacgtggctcgccgacaattattccgacatcagcatcgaggacctcaacgtgcagggcatgagccataacaggaggcttgcaaaacacatactggacgcggacttccacgagttccgccgccaactggaatacaagaccgcacgcgccggcacgaggctgcacgtcatcgaccgctggtatccaagctcgaagacctgttcgaactgcgggacggtgaaagccaagctgtccctgtccgagcgcgtctaccattgcgaggagtgcgggcttgtcatcgaccgtgatgtgaacgcggccatcaacatccaagtcgccgggagtgccccggagacgttaaacgcgcgtggaggaagcgtaggacagacccgccttgagtgcgggacaatgcggcatccggcgaaacgcgaaccaagcggcggcgacagtcgcgtgagacttggagctggtctcggcaacgaggccatgcagatgacttcgctctagcgacaagctaaaacaaagtcatctacaacggacgaaccagccgcggcaccatggcgctgatgcatgactatgccgagctcatcaatgaattacgtccgacagcagagcaattcaccgagatcgagcaatactgggtcaaacgaattcaggcgttcttcaccagcaaatcattcaagctggagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcacggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccacggtcagcagttttggccatacgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcttgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgataatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgacgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggctagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcgccgaccgcggcattttcgttgctcattaatcttctccttaagaacccagagcatggaatcactcattgattttgcaaagtatagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttatccttttcggtaaaggaggccccggcctcttccataatatcattcacaacgaggtaatgacagaaagcaggagaacatgacagacgtcacacatgtcgatcgcgcatcgcaggcttggctgaccgacccgacggtgttcgaggtgaaccggactccggcccattccagccacaagtggtacgcccgcgccccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggagaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaatgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcatgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcgggccgctgcagggcatcgccccttggagcgccgaaagcccgacgctgtacgagcttgacgtcgacgtcatcgaccaggcgggcgacgtcatcgaatgcacgtcccagaaggtcggtttccgccgcttccgcatcgaggacggcatcctgaccatcaacggcaagcgcatcgtgttcaagggcgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgaagccaacctcgaagcccacggcagctggtccctgcccggagacgtcctcaccgaggacaccatcgtgccgggtagcaagcgcgaatgggaaggcgcctgcgtcgaccgcgtcaacagcatgatgcgtcgcgactacaaccacccgagcgtgctgatctggtcactgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgtatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggactcggtgtccgtcaagaacgacaacctgttcaccgccaccggcgactacgtgttcgtcctgagcgttctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcgaccgattgggccgagagcggctacgagctcgccttcggacaggccgtggtgcccgcggacgccaccgcgacgcccgacacgaagccggccgatgggaccatcaccgtgggccgttggaacgccggcgtgcgaggcgccggacgcgaggtcctgctgtcgcgcacccagggcggcatggtctcctacaccttcgccggcaacgagttcgtgctgcgccgccccgcaatcaccaccttccgtccgctgactgacaacgatcgcggcgccggtcatggcttcgagcgcgtccagtggctgggcgccggacgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgcctgtgcagtacacgaacctgaggttcttcggcaccggcccggcggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcgctcataagctatcaagagaatccagaacctttttgaattcatatgctcgacacgcaatgtatccagcgtcgtttataatgattcattgtgccttaatggcacatcgggctatagcgcagtttggtagcgcgcctgctttgggagcaggatgtcgtgggttcaaatcccgctagcccgacaaacaaaaaagcctggaatctcaacgattctgggcttcttcttttatccggccgctaaacgatttatccgtttttatccgatgaccgtagaacctatatggccttgcggtctaagggacttttgtgatgttgggaccccacctgctagtcagttcgattccatgcgacatcgatttccgcttcccaatctcaaatgacaccaaaatacctgcaaccgattgtgcaatcccgtgggcgggagtgggttgcaggtaaaaggtgtcgagttacagcccagaatcacccctaactagtaccgaaatacccgcaaccgcagtaactaacccctttatacctgcaatccggcaaatatggttcagacaatccgcacatccagaccgctatccgaacacaccgtttatactagatcacacatcgaatcaacatctagaaccgaccgtctccaacgacccatagggagagcacatggacgatataagaccacgctgcggctggtgcaatctcagcaatcccgtctatgttgcctatcacgatgccgaatgggcggttccgtcgcatgatgaccaccacctctttgagatgctggtgctcgagaccttccaagccggactgtcatgggagacgatactgaacaaacgcaagcgtttccgtcaggcgttcgatgggttcgacatcgaacggatccggcgctatgacgagaacaagatcgccgaactcatgaacgatccgggcatcatccgcaaccgtcgcaaaatcgtcgcgacggtcggtaatgccaacgcattccgggatatccagacgtcgtacggcagtttcgacgactatatttggcggttcaccggccgtcacgtcatctacgagacaggcatgactacatcccctctgtccgacgccatcgcagtggatctcaagacgtacggcatgcgattcatcggcaccaccatcgtctacgcctatctgcaatccatcggcgtcatcaatgcacatgagcctggatgcttcctgcacagggaaaggtgacccgcgcaaggatttataaggtcgctcgggcagaatctctccgagaggaacccgtgcttctagttattttgcttatcgagttcttggtagcgctctttgaccccggtaaggattccggcagattgttcacgctactgcgcggtgagcgcttcgagcagttcgccgaaagtcaacccaccttcactaccggatgacggatgatggttttgagattttccggtttggctcggcgcgggtcggataggtagatctcgtgatggcggcgggcgtcggagaagtcgagcccgtagccttgcgaacgcgcgtagccgtccagaatcgtcacggttgcgggctcgtcgtcgtacgggcctttgtgcatgacctgcgcgaccacgccttcatcgaagtcgaagagatatgcacgattgatgtcgacttcgggatgcttggaggcaaacgatgccttggcccacgcaaagacctcatcggtcacgaattccggcagacgaatcatcgaagtccaatagaagtcggttttacgcgtgtaatcgacgccgggcacacccttctccatgctccataagccctccagcggaggcacggtgtaatcgaagtacccgtcaatgtgctcgtccggattatttgacttcttgttcattttgatggtgaacgaaatgccgtacagcagttgcatcgccttggcgtagtcgccgccttcttcgttcggatctcctacaccgtccaccgcgacgaaccgcatcgccggcaccgtgacgatggcgggcatcctcttcggctgatacaggtccttatattcctttttatagtcgaatgccatcgctcatttcccctccgccaccgcatcgatctcatcctgacgccgccaccgcttgaggtttggcaacagcgccgacatgcagtcctcggcctgttcgacgctgatatggcaggattccgccatcatcggcgcgcatgcggcgaccaattcatcgctattggcatagtcctgaagaaaaacgccgtcttcatagcagtagttgcaataatctccgtttcgcgttccatccggttcggtgccgtgatcttccgggcggtaaaacggcatggcacaactttggcaaaaaccattgtccggcatttccataagcctcgccatcggcacctcaaaacgggtgctgatcagccgaatcatgtcgatgctcggctctgccgttcccttctcccagcgggaaagcgcctgttgggtgacgaacagctcgtgcgcgaactgcgactgcgtaagacctcgctcctcgcgcacgactttgataacctgaccgatcgacatgactacctcccgacatcggaaaacgattcgcgcgtctcgctgtgcgcttgctgattccagtctaagggcatgtcccgttcgccaagcgcgggtacaacaaaccgttgttcgcgcttgtatcccggaggaagaaacagctcggtcgaacctatttcctctccacccccttcaattctcccggttcctctgactcctttgcgagcgccgcggatgggatgagcacgcttacgtatggggttgcgccagacaggacgtcgtcgtagaagcgctgtttggcgtcgatgaagtcgatggaatcctggatttccgcgagctgctcgaccagccgcgcccgcttgccggcgagcatctacttgcgttcggggatgctcggctcgtggaggagcgtaaggggcgcgagtaggagttcgcggctttgctgcggtctctccctcacccggctacaccgggagctccctcgtcagagggagcttaaattcggtctggttataggcccatgggcttcttgggctttttggcgctcatgagcatgaggaagctgcgggactgggcggtgatcatgaagcccgcctcatagctcagcgccggctcattcgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccgggatatccgaaccgttcagatagatcatcatggagaacgcatgcgtgttctgccagtcgtccatatccatgatcgagccggtgtggtcgaaccattcgacctgcggaatcgtgttcgaatcgtcgccgggctcacggccggtgaagaagcgacggcggtgcaacaccggatgatccaaacgcagatgaatgagtttggaaacgaaggcgagcagttccttgcgtcctttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcattgtgaaaccatcatgcgcggtgatgaagttcacggacgccaccggtcggcggccgttgacctgatacaggtcggagctgcccatcaagcgcgaggcgaattcgggcaacgtggagggctgcgagcgccagaagtcgcgcacggtgtcgcggtagcggccattccattcggaccagctggacgggaagccgcccacctgatagccgccggagcccagatcccacggttcggcgatgagcttgacgcgcgagatgatcgggtcctgctccacgatgtcgaagaacgcggacagcttgtcgacctcctggaactggcgtgccagcgtggcggccagatcgaagcggaagccgtcgacgtgcatttcagtaacccagtagcgcagcgaatcggtaatcaactgcagcgcgtgcggcgagcgcatgagcagcgagttgccagtgccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacttccatgccggcgcgatggtaggccttgaccatggacttgaattcgttgacctgctcgccgcgttccccggaggaggagtaggcgttgtgcggcgcgaagaagccgatggtgttgtagccccagtagttcgacaggcccttctcctgcaggaaggagtcgttgacgaactggtggatcggcatgagttcgatggcggtgatgccgagcttcttcaggtattcgatgacgctcggataggccaggccggcgtaggtgccgcggatgtccggcggcacgtccatgttgaggttggtcatgccgcgcacgtgcgcctcgtagatcaccgaatcgtggtacgagatgtacggatgctggtcgttgccccaatcgaaatacggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatatagttatgccatacgtatgagttctgttcggtcatttcgatgcgcgtttccgcatcgtgctcgtcgaacaggcatagttcgactttctgcgcaacctgtgagtacagcgcgaagttcacaccggcgccgtcatagctggcgcccagcggatacattgatccaggtctgatctgcatagttttcagtatcccactttttttgtgtcagtgatgtgccggggagttgaacgtcaggagaacagcgacggcttatccttgtcggagttcctggcgatgagtctgcgtaacgcctcatgctggatggcgatcatcgaattggatgaggtgatgcgcgtggcggcaaggtcgctccacggaatccacgcggattccacatgctcgtccgcatcgaaatggcgctgctcccgcctgaacgggcccaaatgcaacaccatgatgtgggccagttcgtcggtcatgccttcggacgagtagaaatcacctacgaagtcaacgcccatggtgtcacggtccggcaccacgccggtttcctcggccagttccctcagggccgcgtccatgatgtcctcgccctcgtccatcagtccggcgggaagcccgtaggcgaacatgtccgatccggcgcggtattcgcgttcgatgaggtagcggtcggtggacatgtcgtgcacgagcatgaccacacagggggcgtgacgcagcacctggcggccgatctcgtgttccttgccctgcttgtcggtcagagcgatgcgcatgtcgtccacatggaagatacgcccggtataaacggtttcgctactgatcactttggcgggcacgtccatgtcgatgccgtccgaggaggcgttcagcttatggtcgagccgatgctccagttgttcctgcttgcttccgccaaacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcggtggtcatgccatgatcggacacttcgtcgaatacacgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatggccttgtcaatgatggcggaggtcgggtcggcggcgaacacgatgcggtgcacgtcgtggctcagatctccgacaatgaggcccggctcatcccattcttcggcgtagcgcaatgggtacagggtctcgagaacgtcgatgacttgcttgagattcggcatatgtcccattgtagtgggctattgcggcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcagcggcctcacgcgcaacacgattggtcgaatgcagggccgggaagtagcgacgtcgtccgaaaatggtttccgtataccccttctctcgggcattggccaccagcgattcaaggtaatcgtgcaccttgccaaaggtatcgaaataccggtttttcaacgcttccgcttcacgtggcgcgatcttgagttgctgggcaagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtggactcgccggctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcgtcgatcacctgcgcgagcatggtggcaaaaccccagacggcgttggtggcttggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcggtacggcgacgctgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccctgagctggtcggtggtttccttgagcttgcgttcgctgcgctccacgttgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcgcaataatttcagcgaactcctaactaaagtgccctcggtgggactcgaacccacactgcgcagattttgaggctgcttcctctaccaattgggatacgagggcgtgccaaagcactctgaagagagtagcataccaattcgactcttgcgacacaagacacgcgccaatcctccattcccccggtaaaacaggcgaaacacgtcgatatcgcggacggcgtacccgtgtgttgcccgttctcctgcgtggtttcaccgcttacaatgggctgtagtttcgatgtatcgcttttgttaggagggcttatgagcaacgaaacttaccgtcagttcgatccctggcgcccctctccggtcaaggagatttcccgtagacagattgtggagacgcattatttcaatgtcgatcacgtctcctatgagtcgaatcaaatcggttcgtttgaacgctactttgttcaggagaacaatggcgacactgtggctgtgctggccgtcaccgatgatggcatgattccgctggtcgagcagtatcgcatcgccaaccatcgttggacgttggagattccggccggtcacgccaacaacccgtccgaacgcccgaccgatgtagctaagcgcaagctggccgaagaggccggtttcgacgccaccaagcttacgcagttcacccgttttatgaacacgccgagctattccacccagcacaccgcaatcttcttcgccaccggtcttaccccggcttcccgtcaggaaatcggcccggagactccgcgttccgacgtgcgtatggtgtcggtggacgatgcctatgagatggtggtcaatggcacgattgtggatgccaagaccatggtcgccattttgcgcctgaagagcggcacgctcgatcatctcaacgactgatcgccacgctcgatcaccgcggtgactgtgggccattgcaatcaccacacaatcgcaacataacagataacgaaagcccccatccactttggatgggggctttcgtgtgctatatgctagctgtcagcagctaccagaagcctgaaatcagtcgcaagcgccaacggtgtgcacgtagatggagtcagtgcggcccggctggtgatcgccctgagcagagctcaggatgacgatcttgtcgccgtcagcaaccttgccagcatccttgaggaccttgtccgtgtagaccatgagatccttgcgggacttgtcgtggtagtcctccttgagcaggaaggcttcggtgccccaggacagagccagccagtggtaggtgtgctcgttgctggtcaggccgtagatcggggcggccggacgctcacgggagacgcggtgcacggtggcaccggtctgggtgtaagcaacgatggccttggcgttgagcttgtcggccaggtccacagcggcggaggagacagcgccggtggaggacatgtcaaggttcttgagctccgggatacggtcgaagccgtggtcggtggcgtagccggagatacgggccatggtggccacggtcacatccgggtacttaccaacggcggtctcgttggaggtcatggtggcgtcggagccgtcgaggatggcgttggcgcagtcggaagcctctgcacgagtcggaaccggggagttcaccatggagccgaggacttcggtagccacgatgaccggcttggcgtactggcgagccagctcgatgatgcgcttagtggccagcgggacctcttccagcgggcactcaacggccatgtcgccacgggcggccatgacgccgtcgaaggtcttgacgatctcttcgaggttctccagagcctgcggcttctcgatcttggcaatgatcgggatgcgacggccttcctcgtccatgatctcgtgggcgcggtcgatgtcggtggcgaaacgcacgaaggacatggcgatgatgtcggcaccggtgcggatggcccaacgcaggtcggcctcatccttctcggtcagagccggcagggagacggcgacgcccggcaggttgatgcccttgtgggaggacacaggaccggccacgacgaccttggtgtacacgttgttgccctcgaccttggtgacctcaagacggaccttgccgtcatcgatcaggatcgggtcgcccgggtggcaatcgcccggcaggcccttgaaggtggtggaggtgatgtgctcgtcgccctcgacgtcatcagtggtgatgacgaattcctggccgagctgcagctgaaccttgtcttcgccatcggcgttcttcttgaaccaaccgcagcgaatcttcgggccctgcaaatcaacgagcgcggcaacgttgcgaccagtggcttcgctggccttgcgcacgttgttgtagaccttgaggtgatcctcgggggtgccgtgggagcggttcagacgagcaacgtccataccagcttcaacgagcttcaggaggttgtcgtaatcctcggtggaaggaccgatggtgtctacgatcttggctttacgcatgaatgcctgcctattcttgttcaatttggttcgaggcgcgattgccccatttgccgaaacccagtctactagcgcgagccgactcatgacaagttttcttcacggtgtgttgtgagcgctcacattgttgtgttgactgggtttaagggttgtattctctaacgatttcaggccttttcagcgctttccatgctcttcatcttgatcacggaagccacggatgcgccgccaattgcgagcacaatcacagccagcgacagccatgtgggcacctccggcacccaatggacgccttcgccgccgttgatgaacggcaaggtattgccgtgcagggcctccatgatgagcttgacgccgatgaagcccagcaccacggacaggccggcaggcaggtagacgagcttgtcgagcagagcacccagcaggaagtacagctgctgcaggccgagcagtgcgaacacgttggaggtgaacaccaggaacggatccttggtcaggccgaagatcgcgggaatcgagtcgaaagcgaacatgacgtcggtggtgccgatggtcaggaacacgatgagcatcggggtccagtaacgcacgccgttcttggtggtgcgcagcttctcgccgtcgtagtcgtcggtaatcttgatgatcttgcgcagattacggatgatgccgttctcgtgatattcctcatcttcatcgccgccgagcaccagtttgacggcggtgtagatcaggaaggcaccgaacaggaagaacacccacgtgaagcgggagatcagggccgcgccgatcagaatgaaaatgccacggaaaatcaaagcaatggtgatgccgatggacagcacatacttctgaatctgcttgggcaccgcgaagttcgacatgataatgacgaacacgaataggttgtcgatggacaacgagtattcggtgagccagccggaatagaactcgatggcgggcttggagccggcgaagaaccagatgcatccgccgaagatcagcgccataaccacgaagaaggcgatatgctgcacgcattccttggtggagggcacatgcggtcgacgcccgatgacgaacaggtcgacgataaagaacaacgcgagcaccacgaaggtgatgatttcaaatgcgagtggggtttctgccatgattccctacactaacttatgtatgtgacggttttggggccgttccggtagcgctgatcgccaggcagtcaggggatgtgttgttcgacacgctccgggccgctcaggccaagtctttacggtcgacaacgcatcccctgactgcccgcctcgggtatgggaatttggttacttgttggcttccgtcatttgacggagttcttttttgaggtctcggatctcgtcgcgcagacgggccgcaagttcgaactggagttgttcggcggcggtgtgcatctgttcgctcagttggcgaatcaggtcggcgaggtcctgcgcgggcaggccggccttcaggatctcctcgtggcgtttgtctgcctcgttgggatcgagtaccggcacgcccaggtgcgtgttgccggccttgcccgcgttgcggtagccaccttcaagcaaggtctgggtgtccacatcctccttggcgagcatgtcgttgacgtcgctgatcttcttgatcaggggcttgggatcgatgccatgctcctggttgtaggcaatctgcttggcgcggcgacggtcagtctcgtcgatggcttgccgcatggcttcggtggtctcgtcggcgtacatgatcaccgtgccggacacgtttcgggccgcacggccgatggtctggatgagcgaacgataggagcgcaggaatccttccttgtcggcgtcaagaatcgccaccagcgatacttccggcaaatcgaggccctcacgcagcaggttgataccgacaatcacatcgatcttgccttcgcgcaacatgcgcagcagttcgacgcggcgcaacgtatccacatcagaatgcaggtattcgaccttgatgccgcgttccagcagatagtcggtcaagtcctcggccatcttcttggtcagagtggtgaccagcgcgcgctcgttcttggccacacgggccttgatctcggcgagcagatcgtcgatctgccccttgaccgggcgtacgtcgatcttcgggtccagcagaccggttgggcggataatctgttcgaccaccccatcggacagtcccatctcatagtcgcctggcgtggcggacaggtacacggtctggccgacgcgctgcaggaattccggccatttgagtggtcggttgtccatcgcggagggcaggcggaagccgtgttcgaccagcgtgcgcttgcgggaggcatcgccctcgtacatggcaccgatctgcggcacagtgacgtgtgattcgtcgatgaccagcaggaagtcgtcagggaagaagtcgagcagcgtgtgcggcggggtgccagcggcgcggccgtcgaagtggcgcgaatagttttcgacgcctgagcacacgccaacttgggtgagcatttccagatcgtaggtggtgcgcatgttgaggcgctgcgcttccagctccttgccttgtttgcgcagttctgccaggcgttcgtcgagttcctcgcgaatggttttgagcgcccgttccatgcgttcggggccggccacataatgggaggccgggaagatgtggacttcgttttcctcgtcgatctcgtcgccggtcagcgggtgcagcgtggagatgcggtcgatctcgtcgccgaagaattcgatgcgcacggccagttcctcgtagaccgggatgatttcgaccgtatcgccgcgcacgcggaaggtgccgcgcgtgaaggcgatgtcgttgcgcttgtactgcatggccacgaattggcgcagcaggtcgtcgcggttgatttcctgcccgactttgaggaagagcatgcgaccggcgtattcttccggcgtgcccaagccgtagatgcaggagacggtggccacaaccacgcagtcgcggcgggtcagcaggtttgcggtggcttggtggcgcaggcgctccacatcgtcgttgatgttggagtccttttctatataggtgtcggtctgcgggatgtatgcctcgggctggtagtagtcgtagtagctcacgaagtagctcacggcgttgtccggcatgagttcgcggaattcggcgcatagctgcgcagcgagcgtcttgttgggctcgataatcagggtcggtcgctgcagcttttcgatcagccaggcggtggttgcggttttgccggtaccggtggcacccataagaaccacatcattctcgccgttttcgatgcgttcggccagttcggcgatggcctgcggctggtcgccggatggcttatatggcgatttgacgacgaaaggcttgtccgcgcgctcgatattgaatcccatagggcctcatcttagcgacctgcgcaccatcctgcgtatatctcacccacttgggccagcatctcgggcaatggatgggtggagtcgatgacgatatcggctatggcccgccgctcctcctcactggattggtggcggatgcgggcctcggcctgttccaggctcatgccgcgttcctcgaccatacggtcgagccgcatgcacacgggagcttcgaccgtgacgatatggtcaaaggcgaatggaatatcgtcaatgacctcggcgagcagtggaatgtcgtgaatgatgatggctgcctcggggtgctcatgctccagtcgcgccgcctcggcatagatcaatgggtgctcgatggcgtcgagccgttcacgtgcgcccggcgcggcgttcgcgccgaagacatgatcggcaatccatggccggttcatagtgccatcggcgagcaatgcatcaggaccgaactcggcgacgatctgtggcagcgccactcccccgggttcgacgatctgatgcgccagcgcatcgtagtcgatatgcaacgcgccgagttgcttgagttgcgccgccaccgtacttttgcccgcggcgatgccgccggtcagtcctattcgcatcatggtgcccatgatagctggcgctcccctcggccggctatcgccgacagctcccctcagggaggggagccggctcgcgtagcgagactgaggggagtcattggcggataactccaaaaacacaagaaacccggcccaatcggaccgggtttctttacacgctaagcgctagcttcgcggcaaactcacttgccgagcagctggtcgcgcagggcggcgagctgatcggagtcggcgagggtaccggtagccggagcagcggaagagtagttggaggtctcctcgaccggcttctcttccttcgggccctggccgtcggcggctgcggattcggcagcgttctccagctccttggccacgaactccttgtgctcctcccacagctcgtgagcggcggcgtactgagactcccactcctcgcgctgcttctcgtaaccagcgatccactcgttggtgttcgggtcgaagccttcggggtacttgtagttgccctgctcgtcgtactcggccggcatgccgtagatggccggatcgaagtcctcggaagccgggtcaacggagtcgttggcctgcttgagggacagggagatgcggcgacgatcgaggtcgacgtcgatcaccttgacgaacacggtctcgcccggcttgaccacggtctccgggttctcgacgtgacggttggcgagctcggagatgtgcaccaggccctcgatgccgtcctcgacggagatgaagacaccgaactggacgatcttggtgaccttgcccttgacgatctggccgggaacgtgggtgcgagcgaagcgctgccacggatcctcctgagtcgccttcagggacagggagatacgctcacggtcgagatcgacgtcgagcacctcgacggtgaccttgtcgccgaccttgacgacctcagacgggtggtcgatgtgcttccaggacagctcggaaacgtggatcaggccgtcaacaccgccgagatcgacgaaagcgccgaagttaacgatggaggacaccacgccctcacggatctggcccttcttgagctgggacaggaaggtctcgcggacctcggactgggtctcctcgaggtactggcgacgggacaggaccacgttgttgcggttcttgtcgagctcaaggatcttggccttgatcttctggccgatgtacggggagaggtcgcggacgcgacgcatctcaacgagggaggcaggcaggaagccacgcagaccgatgtcgacgatgaggccgcccttgacggcttcgatgacggtgccctcaacgacgccgtcagcttccttgatcttctcgatgtcgccccaggcgcgctcgtactgggcacgcttcttggacagaatcagacggccttccttgtcttccttggtgacgacaagggcctcgatggtgtcgccgacctcgacgacttcgtcaggatcaacgtccttcttgatggaaagctcgcgggaggggatgacaccctcggtcttgtagccgatgtccaggaggacttcgtcgtgatcgatcttgacgacggtgccctcaaccagatcaccatcatcgaagttcttgatggtggaatcgactgccttgatgaagtcctcttcggtgccgatgtcgttgatggcaaccttggtgacttcagtgttgttctctgccatgtaaatatatggtttctaatagtggatggataatttctcgatattcagttatacgcacaccctacaggcatacagatactcacaatacaagcaactctgcccaaatttcctaggaaactctaggcgtgtcgttcggccatttccacgacgttggctaggagcatggctcgggtcatggggcccacgcctccggggttgggggtgtaggcggaggccttgtcgtagcaggccttgtccacgtcgcccttgatgcggtagcgaccggcttcttcgtcgtagacgcggctgacgcccacgtcgaccagcacggcgccgtccttgattttgtcgggcgtcacgaatccggccgaacccattgcggcaacgatcacgtcggcgcggcgcatgtggtcggccacatcccgggtaccggtgtggcacagggtgacggtggcgttgacggcgttgcgcgtgagcattaggccaatcgtgcggccaatggtgatgccgcggccaagcacgcacacttccttgccgttcagatcaatgtcataggcgtcgagtagctcgagcacaccgcgcggagtgcaaggcagcggcgtcgaaatgtcgccgcgcacatgcagcaccagttcgccgaggttgtacgggtgcatgccgtcggcatccttggccgggtcgatcatgtcgatgatcgcgttctcgttgatgcccttgggcaacggcagctggacgatgaacccggtgcaagccggatcttcgttgagttcgcgtacggcagcggcgatgtcgtcgaagctggcgtccgccggcagttccttcttgactgaggtaatgcccacttcctggcaatcggcgtgcttgccggccacgtacttcatcgacccggggtcctcgcccaccagcagcgtgcccagccccggttggatgccctgcgccttgagcttgttcactcgctcggcaaggttggtcttgatttcggccgcaatctgcttaccgtcgatttttgtggacatcaacgccctcccctgtagtttcggtgcattctatcgaaacgataggctatcgttggaacaagtcaggattatatatcgttcgctctcacgaagaaggcgtgccatggggactcaaatcacacgacttacgcgactcgccgcagccggcctgagcgccgtcctgttgttcgcgaccaccgcatgcgcagccacctcccccgctgaaaccgagccggacaacaagaccagcgttcccgcaccgaccgggccgatcaatgtggtggcctccctcaatcaatggggctcgctggccgccgagctgggcggcgatgatgtggaagtcacgtccatcgtgaactccaccaatgtggatgcccacgatttcgagccaaagacctcggatgtcgccaagctgtccaaggcccaaatcatcgtggccaacggtgcgggctacgattcctgggccaccaaatcgatgaccaagaccacgaatatcgtatccgccgcttccgtcatgggtgccgtcgagggcgataacccgcatctgtggttctccaaagacgctcgatccagcatggccacggccatcaccgatgcatatataaaggcactccccagcaagaagaaggccttccagaagcggctcaaggcatggcaggcggacgagaaatcgttggaaacatgggcgtccgagttcaccaagtcccactccaacctcacctatgcagccaccgaacccgtggtctattatctgatggccgatcttgggttcaaagatcagacgcccaaggggtatacgcaatcgaccgcttccggcggcgaaccggcacccgcggacctgcagtctttccagaaactcatcgaagacaagggcgtggatgtgctggtcaacaacacgcaggaagccagtgacgcgaccaatatgatcactggcgctgccggtcgcgccgatgtgccggtagtcgacgtctccgaacaaatgcccaaggacgccgacacgctgaacgcctggatcaaccagctcatcaacaccatcatcgacgcggtggatccaagctatggctgcgaagacgccacggacggcgataccgcggacagcaacgcgaattccgatgattccagcgccgaaggctccgccacggatgatgccaatgcgcaagactccaaggccagcaccggttccagcacggaccccaagtacatccgtcagtgcaaggcggccgcatccagtgactcatctcaggattcggcaaaggccgatgccgccaatggcgattccggcgatgcctccggcaacgaccagaccgactccggcaaatagttagaagcaaaggacaccggcatcggattcgtgccaatgccaatagacgccttgcatgagaagggttgtgcgaccattgtcgagatggccgcacaacccttctctttggttatcaccatccgtacacgatattgagaacgattgtcagcatcgtttgccacaatcgggcgttatgagtgaaacttccgattgcatcgtgttcagcgatgccgccatcaagcgtggcgaccatatcatctggcagcatggcaccttcgccattcccaccggttcggtcacggccatcgtcggcaccaacggcaccggcaaaaccacgatgatgagggccgagctgggccttttgccgctctgtcatggcagcctgaccgtgctgggcaagcccgcaggcgagatgaacaaacgcatcggatatgtgccgcagagctatgtggcgaatgtcgattccaatctcaccgccgaacaatccgtgttgctgggcctgaccggcacccgattcggcatccaccccatcaccaaggcccagaaagccaaagcgctcgaggcgatggagttcaccggcatcgccgacaaggcgcggtaccgtctgtccgaactgtccggcggtttgcgccagcgtgtggccatcgcccaggcgttggtgtgcgacccacaactgctgatgcttgacgagccgttggccaacctcgatctggccagtcagcgcgccaccgtacacgtgctggccaagctgaaccgcgaactgaacatgaccatccaggtggttgcgcacgatctcaatatggtcttgccgattctgaccggtgccgtctacttgctcgacggtcacccgcactacgccgatatgcacaaagtgctcgactccgacctactcacccacctctacggcacacaggtgcaggtggtcaccactccgcagggagacatgttcgtgaccccgacgccggatgagctccaggaccagccgcaggatatgcacacggcagccgaagtggcgcaattgcaccatcacgagcacggcaatgccaccaatggcagtgccgccatcagcgccgagaatcgataacatcaagcgagccgacccacagcccatcaacggactgcagctcaggcatggagaaaatacagagacatgagcaccatcaacttttcgtatgatcccgaatggctggatacactgtccgctccattcatgaccaacgccttcatcgccggcctgtgcattgccctggccgccggtgtcatgggatacttcaccatcgcccgtcgttccaccttcgcggcccatgcgctggcccatatcggtctgccgggcgcgaccggcgcggtgttgctcggcctgcccgtgtcactgggcatgggcgtgttcgcactgggcggcgcactggtgatcggtgctttgggcaagcgcgtttccgagcgtgaaatcgccaccggcaccgtgctggccttcgccaccggcttgggtctgttcttcgcgcgattgtcgagttccgcctcccagcagatgcagtcgatcctcttcggctcgatcctgaccatcaccaccggccagatcatcggcttcgccgtgttcgacgtactgctgctggcattgttggccatcatctaccgcccgctgctgttcagctcgctggatgagcaggtggcacaggccaagggtgtgccgatcgggctgatgaacgtggcgtttatggcgattatggccggtgtgatcaccatcgccgtgccggcagtgggcaccttgctgattttcgcactggtgattacgcccgcggccaccgccaatattctggccggctccccattcaaggcgatggtgatcgccagcgtgctgtgcttggtgtcgatttgggccggactcgtgctgtcggcgatgttccccgctcccccgagcttcatcatcgtgacgctttccaccctgttctgggctatcgccaaagccgtggagacgatgcggaagtaatctcatccattttttcttgcccccgctggcgaattcatagcgggggctttgttatatcttctccaccaaggcattggcgatggcggcgatgccttcgccgcggccagtgaatcccatatggtcggtggtggtggcggtaaccgataccgggcaaccaaccgccgcagacagggcggcttcggcttcagcacggcgtgtgccgattttcgggcggttgccgatgatcgccaccgaggccgatgccggcgtatacccgttggatgccagatgcgccacaacttcttgcaacatatcgatgccatgcattccggcaccatgcgcgtccgcaccgacaccgaacagtgaaccaatgtctcccaatcgggcggcggcaagcaacgcgtcaatcagagcgtgcgcggccacatcgccatcggaatcgccttcgatcccctcgtatttggcggcatcggcctcgctgcatgaatcaggcaccggccagtagagcccggcaatccacagttcacggcctgagccggcaggcgcaaaacggtgagcgtcaaaaccttgccctatcagcactcctgcagaccccatgcagtccccttcgatggcgttgcccagacgaacggcagcaaacgattatgaatcacgaagccccggcgcatcgcataaggacacgaccggggcctcaaaacaatcaaatcacttcttcttggacttcttctcggcttcaacacgagccaaagtatcggccgcggcctcttcgggctcggcggtgtgatgcttgtcgtcaccgggctgagcgggctcgtagcccagattcacgtcgagcagacgctgggcttccgcctcgtcgatcttctcggacaaggcgatctcagaagtcagaatggcacgggccttggtgagcatgcgcttctcgcccgcggacaggccgtgctcgtcgacatcgcgctgggcgagatcgcgaaccacttcggcgatcttgttgacatcgccggtggcgatcttttcgacgttcagcttgtaacggcgagaccagttcatctctttctcgatgatcggggtccgcaggatgccgaacaccttggccacttcggatgcggagacgatgtcacgcacaccgaccttcttggcattgtccacgggaacgttgatgaccaaaccatcggaagagagtacggacaactgcagatattcgcgcgtcactcccttgaccgtccgctcggtaatggcctccaccttcgctgcaccatgacgcggatagacgaccatatcgccgactttgtaagacatgtaccctccgagaactgacggcttacacacgaaaactcgaataattatgccatgcggtctggaccacccctatgagagcgctcacaaccacggaaacacaacgaaaagggcaagaattcgccattttcgacgcgccaatgtagcgtttacgactccaacgcacgtagactttgggtcatggctgaagaaacgaagatcaaggaagataccgtcaccgtgcctgtcgcccaaggcgacctcgatgcggtgagcaatgctgaattctacaatccccacggagttctcggcgggcatctcggcatcggcaagcatgccgacaccgccacaatccgcgtgctgcgtccgcttgccaagtccgtgaccatcctcacccaggatggcgaatacccgatgacccacgaatacaacggcgtgttcgtggttaccgtgccggcttccggcactaagaagcagcccacgattcccgactaccgtgtcaggaccgagtgggaaagcggcgcagtgctcattgaggacgacccatatcgctatatgcccacagtcggcgacatggacacctatctgttcggcgagggccgtcacgagaagctctgggagacgcttggcgcgcatgtgctgcgctatgacgatccgatgggcggcgcagacggcacgcccggcgaacaggtggtaggcaccgcattctccgtgtgggccccgaacgcccatgccgtgcgcgtagtcggtaacttcaacgcttgggatggccgccgtcatgccatgcgcgagctcggctcctccggcgtgtgggagatcttcatccccggaatcggcgcgggcgagacctacaagttccagatcctgaacgccaattacacgtgggagatgaaggctgacccgatggagcgtcagcacgaagttccgccgaacaccgcctccatcgtcaccgaatccacctacaagtggaacgatgacgcctggatgcagcaccgccgcaccaccaacccgcatgatggcccggtctccatctatgaggtgcacgccggcagctggaggcagggactgacctaccgcgacctggccaagcagctcgtggactacgtcaagcaggaaggcttcacccacgtggagttcatgccactggcccagcacccgttctccggctcctggggctatcaggtcaccggctactatgcggtcgactcccgtctcggttcccccgacgacttccgttacctggtcgaccagttccatcaggccggcatcggcgtgatcatggactgggtgcccgcccacttcccgaaggatgccttcgcgctcggccgcttcgacggcaccccgctgtacgaggacccggacccgctgcgcggcgaacaccctgaatggggcacctatgtgttcaacttcggacgccgcgaagtacgcaacttcctggtggccaacgccctgttctggcttgaggacctgcacgtcgatgcactgcgcgtggatgccgtcagctccatgctctacctcgactacagccgcgaacccggccattggcgcccgaacatctacggcggacgcgagaacctggaggccatcgacttcctcaaggaggccaccgccaccgcgtacaagaacaaccccggcgtcatggtgatcgccgaggagtccaccgcatggccgggcatcaccgcccccacttccgccggcggcatcggcttcggcatgaagtggaacatgggctggatgcacgacaccctcgagtatctgcacgaggagcccatcaaccgcaagtggcaccacaacgagatcaccttctccatggtgtacgcctactccgaacactacgtattgcccatcagccacgacgaagtcgtgtacggcaagggttccctgtacggcaagatgccgggcgatgactggcagaagctggccggcgtgcgttcgatgttcgcctatcagtgggctcacccaggcaagaagctctccttcatgggcaacgagctggcccagtggggcgagtgggatcacgacgcctccatcgattgggattgcctgaactggcaggagcaccgtcaggtccagaccatggtcgccgaccttaacgccttctacaaggcgcatccggcactatggagccaggacttcgacccggccggcttccagtggctgaccagcgacgatgccgaccacaacacgctgagcttcctgcgcatcggtaccaagggcgagaccttggctgtggtggtcaacttctccggtgaggcctggtccgattaccaggtggcgctgcccaccggcggcaagtggaccgaagtgttcaccaccgatgacgccaagtacggcggctccgacatccacaacggcaccttcgaagcggtcgagggcgaatatcattcacgtccgttctcggcgaagatcaccgttccggctctgggagttgtattcttgaagccggaagactgaactggtcaacaggctgaaaggtaaccggtttatttatgctcaataccacagcgcgtcagaatacgacaccgcgcacggtgctggtggtcgaggacgagcccacgctcgccacggccatcgcccagcgcatcaccgctgaaggatggaccgctcgcgtggccggggacggcgcttccgccgtccaggccgcgtcccagctacgccccgatctggtgatcatggacatcatgctgccggttatggatggtctagaggccaccaaacgcatcgtcgccgaacgtccggtgccggtgctgatcctcaccgcacgtgatgacgaggccgacaaggtcatcggtctgggagcgggtgccgatgattacatgaccaagccgttctccatgcgcgagcttatcgcccgctgcaaggcgctgctgcgccgcgtggagcgtgcgaaggtcatcgccaagaactcggagaacgagaagctgctcgacttcggttcgatggtcatcgacccggcccagcgcatcgtcaccgtgaacggcgaacaggtgcatctgacccccaccgagttcgatctgctggccacgctggcccgccgcccgaagtcggtgctcacccgcgaaaagctgctcgaagaggtctgggactgggtcgacgcatccggcacccgcaccgtcgacagccacgtcaaggcgctgcgccataagctcggtgccgataccatccgcaccgtgcatggcgtgggctacgctttcgagccgccgaccgcgtgatggcatccaaaaaacaacagcaatcccggcttgatgcgatgaaacctcgcgtcaagccggttgatttgttctcatctctgaagctggaactcagcgcactgatcgttatcgccactgccatcgcgtttgccatgtgctggttcctcctgaaattcggctggtccggttggatcgccatgccgctgactttggtggtggccttgggcatcacctattttttctctcgcggcatcaccgctcccctacgccagatgcgcgatgtggccgaagccatggcggatggcgattacacggtccgcgtggatatcgatcaggatcgtcatgacgaggtcggcaagctggctcgctcgttcaacgagatggccggcgaactcgagcatgccgataaaatgcgccgcgacatgatcgccaatgtgagccatgagctgcgcacgcccgtttccgctttgcaggcgatggtcgagaacatggccgacggcgtcaccgagcccactcccaccaatctggagagcatcctcacccaaacgcagcgtctctccgatctcatcgccttcctactggacctgagccgtatggaggccggtgcggcgagtctgaatatcgaaaagttcaacttcgccgactttcttgacgagaccatcgagccgttggaaatcgccgatggtggccacgcccacgacatccgcgtcaccgtgccggccgacatcacgatggaaggcgatcaggaccgcctgcgccagctattcaccaacatcatcgccaacgcgctgaaacattcggccgacggcaccaccgtgctggtcgacgcccacgaggacgaaaaccaaggcaccatcgtgaccaatgtggtgaatttcggctcccagattgcaccttccgaccgtttggacatcttccggcgctttgtcaaaggcaagacgggtcccggcaccgagtcgggcggcaccggtcttggcctgtccatcgcgcgctgggcggcccaattgcacggtggcaccgtcaaagtggtcgacgacacgcgaggtgccgatttcgaaatcatcctgcctaaatatcacatcgccgaacgctgatattgtccgacgtcctaccgtatactgtattcgaacagatgttcgaatacagggtgggaggcgcagcatgacacagcaatccgagtcacaggccatggcgcacgaggccacgctgtttgttatgcagatggccggcgattccatgatcaatgcgggtattcacaacggcgatctgctgattgtcgatcgttcgttggcaccagtccccggagatgtggttgcggctgtcatggacgacgaaatcgccatcaagcggctggtttcacgggccggcatcaccatattgcacgccgagaatccgcgataccccgattacatgccgagcaacggcgcttcgcctgctatctggggcatcgtcaccgatgtcattcacccgttgatatcgtcatcggaccgtcgcaccacggcatccgccaataccagcacgcccaccaccttggtgccggcctgctgaaacgcctgaacgcattgccgcacagtggcacctgtggtgacgatatcatcaacgagaagcaccgcgtcgccattgccgatgagatcacgcttcaccctgacatgaccggtgatacgacgggcacgctgtgccgaagagacctgctgcacggagcgtgccttggtggaggagctcagggcattgcatggtcgcgcatcgacgccgtacccacgcaatgcccctgccaccgatttggccaacggtgccgtatgggcacgtcctcttcggcgcattgacgcccgcgatgatggcaccggaaccaccaatacgcgatgacccaagcatgatgatggtattggcgtcttgttcagcagcgacaccatgatgcggccgaacgggccgtcaagctcggtatcgtcgtggtccttccagtcgagaatggcacgacgtaccgctccctgataaatcgatgcggaccatatacgggctccgccaccactgtctgcatcccgttcccggcattgcgcgaacagggcccagcatgccgcacacaatacctcatccggcgcgtcacacccagcgcagccgcgtggaaacagcagattgcagacctgtgcccacatcgcatgccaccacttgtatacgctcggcccgtccataacgcgtcactatcgagctggagtatcgaatcgcgcaagcagtgcatccagcagttgtaccgtatcttgcggattctcaacacgaacaccgatcgcaccggcctcaaccgcgggatagtcattacccgtaggcgtcatgcgatcacccacgaacaccatttcatcggcccgtatgccaagtgtctgcgtcagcttgcgcacggcataggccttatcgatgccgcattcgctgacatccacactggtgtatccgccggccttgacccgcatatgcggcagatcggccttgaccgcttcgaccagcgcctgtttcttcgtgttatcgcgatcccatgcctgcttggccgctacgggcgcgaactgcccaagagcggagaaggtgatctggctgcccctgttctcgattcgaggcccccatacctgctgttcccacaatcccagttcccaggcatgtcgctcaagactttccgagacagcggccacggtggcttcggacagatcatgcgcatacaccaaggcccattgcgtgccatcccaccggtaataccgggagccggaggtaggcatgacatgcagattgccgcgcctggcattcggggtgagtacatccagcacctgcgaggtgaccaccgccatgccgccccctgagatcagggccaccaccgtatggtcgagcaacgcacagaaccgttcgatcatcgcgggcttcatcggctgttttgagctggccagtgtgttgtccaaatcgaaaccgaacaccttggcgttggagcagacattatcgaaatcaagttcggaccacgaacgtaccaccatttgtcgtgcctccctcgttgacgaatgttcacagccaatgaaccaatcctaacgcatgttgcctccgccatgccctatggtgggaaccatgcttcagccaccttggaacgcacgaatctaccgcaaccgccacggtcgcggcacacgaaccccgatgttcggcacccgtctgccccgttaccgcactcgcaccggcatgttcgacgatatggtggcggcccaggttcgcaggctcggccaagcgtggccggaactgatacgtccgctccagttcgcggtggaggatgtgccgccttcggatccgacgccttggcagaccgagccgaatatgacgtcccagtgcttccccgccagccacggcattcccgcacgagtcgtgctctaccgcatgccgttgcagaccgaggcacctaccaagctcgaactgcaattggccgtcagggatgagctggtggcccgcatagcggaattgtatgggcgcaggcccgaggaaatcgaccccgactggggcctgtgacaacactgcgggccgtgtcacttgtaataaggtagtggcacggcccgcagctatatcgccgccgaaacatcatcaaactgacgcttcggcgagcatacccttctacttgacgatggaggaatcgttccgagcccagacatgaaccgtggcgggcatcagcgttgaagcgtcgatgacggacaatccggcgatgtccttgtcttgcaacgaatcgtgactgaaccgcgctccccagctcactttcttggatgagtcctccaacatcagcacgaccgcggtgccatgatcgccggaaagattgccggcttcaatcgtttgtgctgcgttcgcatccagtgtgatttccttggaggttaccgaagcaccggcatcatcgtaggcgcgcaaggtgaccgtcctgcgcgcattggacgtattggccagcgtgatggaggcctttactccgtcgggaagggccaaccccgagaattcggatggctcgccggcattgaccaatgcgaaatcggcttggccggagtcaccggagcgtgtggccttgacggagaacgacacggcgtcctctgcggtggacatcacgcccaacgccccatcaggagcttctcccaagtcgatcgccgtcactttatcagcagtgacggtggcatctttggcgggaaccaagcctttggcggtaatccatgacagcccggtgctggtgtctgccttggcgaacagataagcggtgaccgcatcgccggcagtgatggacggcgccaccgatgcattggatgcggtcggcagcggcagcgcgaaatcagaacccttcggtgtcagaccatccatggtcaccgtgcgcaccacggacgcgataggagtctccttgctggaaacggtcacgaacagaccatgctgcccatcgaccgcggcggacagttccatcgaggactccccctcggctggcacagacagcgtggattgggtggacaatgccattttcccggctgtctcggaaccccagacggcaatgtcgacggtggtcggcttggtggagagattcgagacgatgagctgctgtgtggtaccggtcgtgctgtcggagagcaggaacgactggctgagcgaggtcgatacgcaggatgccgccgatatgcctctcacatcgccatcatcggcccatgatgcgatggtgccgacggtgccggtgccagctgcggcctgcagcatacgggtattgatcagacgagctccctgattgatcttctgagcaccggttttcaccgaggaatcgtcggtcgaatcggcgtctttcaaagttacgtcatctgaactggacttttgcccgatcgccgagacagtggcgctgtagacggagccgaacgccgcatagcgcgcttgtgtgctcagattgccgacagtggcctggaaggcgctgtcgccgtacgtgccggtatcggccaatcctataggtgccgggcagtaggtttcggactgggtcggactaacggtctggtcgatggcattatcggaagcggccaccttatccacccagatattggggatgggggccatgacgagaacgacgaacagcgcaatcaacaccagcatggtgatcacaccgagcacgatgccgatcgcacgtttgaaaccagaagttttgttgctcatgcctgctcctccaatccgtaggacggtcgtctgcgaggcatggcgaccaagcagtacaacgccgtgatcacacctaggcatatcagccaggcgtgcctccagacactatgctgtgcacgttgctgccatgaggtatccacctgctgtgaggcgctgctacgcagcgtcagacgatagtagctgccgctatccgtggagaccagggactgggtgccgttcgatgcggcgatattcgcgctcaactgttcatacggcatgtcgttcaaggaatcgccggtctcgggaaccacgtagatgccgccgaatccaagcgcgctgatggccgcgatggcctcttcgtcgggattggacagcagcgaggcacaggcctgggccagttgttcgtcaaccgcatcatgcttgccggacagcaggcgcgcccgctggaccggagagctgtcgatcaaatcgccgcgcgaggtgcgcatcaccgcatagttgacgatgttgcgggtctccgcgctcacggcaagcacacgatgatcggcaccggcctccagataatcggtggtgaccatgggcaggccgttttcagacacgcccagtcccgcatccttatgacgttcgatgccatacatgcattggatgccaatgcagcacaccagtatcagagcaagcaccacacggccagacacgatgagcacatgcagacggtcctttttcgatgcgggatcactgccagacgcatgcaacggttggaatcgcttcaccgccccaccagcgacgagacacacgcaggcgaggaagcccaatatcatcatcgcgatgcccggctgcgcggaaccggccacgacaccatcggcatccacggttatggccacatggctggagaccagggcgagcgcgcctccgcagacgattaccacccacatcagtcgcgaggtccgcaacgcgaacggcagcaccagcgaagcaagagcaagcagcgtgatgacgccaaacagcacagtgaccgccaaatcggcataatcagtcgaccccattcgccatcccagcgcacgctgtgcggcctcaagcagactcagcgacgccggcgacccgttggcggatgacgttggcaccgtgatgtcgccgaacagttgacgccacatgcccaaatcggcgtaacgcaccgcattgacgagcgtaggagccaccgcaaaggcggcaggaaccggaattagcaacagcatggcgcgcttgcgacgcacgaatagcaggaacatcaggaacacgacgatcagcgcgaacagcagctgcggttcagcggccaccacagggatgaagcacagtgcggcgatggccgcggcctgaacggatgtgcgcggcttgagcgggtcttcggtatggtacatgcccacggcacggaacacgaatgcgaacgcggccggcaggaacaccattacggtaagcatcggcatattggcctgcgcataccagccgaacataatgccggtggatgcccacagcagtcctcccagcacacgaaccacgtccgagcgggtgaatacgcccgccagcgcccagaacgacaatgcgctcagcggcgcggccacaaacagtatcatcgccaaagcggcggtcacatggccgagcgtgaccaacgaggccagcatcagcaccagcagccacggcgtgggcggcgcaggaatgccggtgccgctgccaaacacccacggcgtggtggcggactgcaccagttgcgtgaagctggcaccggtgggaagcaacacatcggaatacaacgatccgccggagaatatcgaacggaacaccggccaatacatcaccgcgatggccgcaaagcacaccagcgccatcaccacggccgcactccagcgatatatggtgcgtgtccgcagatgggcacgttccagcggactgagcagcactctgccctgctgggattggaatgcatcccgacgatcatggaactgcttgatctgctggctgtctgcgaacaagacatgcagggacgatgcggcgaccttcgattgtctggccaccagactgcgtgatttcatgtttcccgcgatatcggccaaggccagccatggcaggcacaattgcacccatgcttcatacggcttcttgccgaacatcatggatatggccatgccaaaactgcggagcagcctccacagccagacgataaaccaggacgacatggccaggtccgtgtacagataccgctgttgggagcgatgcaccgtcatcgcatgattgaccgtgtgatcgtccttaagcggttccccgcctcgcgtacgaatgccctcataccgtgcgcgacgatgtgatatctccgcttgcgggacaaccaccacgcgtccgccgctcaggcagacacggcggcagaaatcaaccgattcgctgtaggtggtcagccaggcattgatgccccgcagtcgcgtgaattgcgacatggacaccagcgcgcctgccagcgacaccgcaaacacatcctgccgcccgtcatactgctcctgatcgggttctccatcgaccaccagggaatgcacggcgtggtgacccgcatacataccgacatcatgcagatgggagccttcccaatcgcactgtttgcacccgagcacactggcgcccggcgtattgcgccacgcctcaagcaatcgttcaaggcatgagtcatccgaagggcgggaatcatcatggagcagccacaatgcgcggggagcgtcatccagatcggcacgatccaatgcccggctgaccgcatcgccgaaggagcgtgcgcccttggccgagacgatgtgaatggtcacatgcttggactgcggcacctccatcaccggccccgatggcgaggggatgacctcgaacgaggtggttatcctcgaactggtgcgcccggtcgcgtcggcgatgatgacgacccccggaagaacattctgcgtcaataccgaacgcaatgtagaccggaggaaacgcatatcctcctcaacggtgatcacagccgtaatgccggtatccacatcctgcctatgcgtatatggtcgagaagacatggcgtcggccaacgcctcatgaatatcgctattacctgtcggactcataaactcccagtgtacgcaccagacttgaagggggtgtgtggagctacgcccgctcccggtgctctcgcttatatcgacggcgttcgcgctcgctcatgccaccccaaataccgaatcgctcatcatggtcgatggcccatttcaggcattgctcacgcacttcgcattttgcgcacacacgtttggcatcacgggtcgagccccccttttccgggaagaacgcctccggatcggtttgcgcgcacaacgccttgtgctgccaagatacatcgccatcaggtcggaatagtccccacaattcgtgccatggctcttcggctgaatcgtcgaccacaccccacatgcgattctccttgcctattgagcttttcatacggactaaattacacacatgcaatttcggttttgtcaaattctttctcgtgtcattacatcatttttatggaactgtgtgctatggcgtgaacgcgatgccctgacgccgttgcacatgatattgtgccgttcctgcgcaggaacaccatagcgcaggaacacccggcggatgctgtgtcaaagtgtcattcagacaatcgacagtttcaggaggggttatgacgcaggaatcaggtggggcggatccgcatatcaacccgccaagcttcattcctgcgggaaatcgacgcacccggccttccgggcaggtgccacgctccttcgcccccgcccgaacctcgcgccagtcaggtcaagctccatcggcccgtccgtccgtcacgggaaatgacatcgaagagcctcaactgaacgccaacgccacggcaagcgccaacgtcgcggacaacggcaggcggactccgcccagtttttctccgaaaaccggacgcgccactcgcagcacggctccggatgccgccgcaccgcgcagcattccgccgtcgcgagcgcggatgtcttccggctcatcccgcaacgccgtgcgcaatccgtcggatatgccggtttcccggccctcatcgccagcagcaaacgtgtccacgaagttcagccatcttggccggccggcggcggcaacggcgaaaacggtaacggcacgccgtccgcgagccttacgcatcaccctatgcgcaatcgcggtactggtggcggcgttgattctttccgttttcggtgcctggcaatgggtggacagcaaactgaatcggagcgactggctgaccgacacccccaacacgccggcctcgacttggctgattcttggctccgatgagcgtgacggttccaccgattacggcggcgtagacaatatctctggcttcaggaccgatacgattctggtgctgatcaagcccaaaagcgggccgagttcgttggtttccattccccgcgattcgctcatgaacgtcgataaccagtacatgaaaatcaatgcggtggcgctgattgcgggcaagaaggctttggtaagcaacgtcgagcagatcaccggccagaaaatcgatcatgtggcacagatcaagttcggcggtctgcagaacgtggtgaacgccttgggcggtatcgaactgtgctatgacgaggatgttcaggattcctattccggactgaactggaaggcgggatgccatacggcggatggttccaccgcattgtccttctctcgtatgcgatatgccgacgcgcgaggagacttcggacgcaacgaacgccagcgacaggtcatctcggccatcgtcaagaaggcttccagcagtgagaccctgaccaatccgtccaaaatcgtggcagtgtccaatgccgcgatgagcgcactcaccgtggacgagaagaccaacccttacacgttgctcaccatggcgttggcgttcaaaagcgccaccggctcgaatggcatctccggcagcgtgtactggtccgaccccgattattacgttgatggcgttggttcctcggtgctgcttgacgacgccaagaacaccgaactgttcaatcaacttgccgacggcacgtataaggccggcaccgtgggcaatctggcggaaggctgaccgacgctttcccggagcccatcggcttcatcatcggcgcatgatcgtcaccgttgcctacaccgccaatcatgcacgggcaaaatgtcatgtggataactcggcaagctagaaccacataccttgattcggcttgcgctttcggcatgcgttcccccacgctggaagcatgacatcacagcagaacgattcgaagcgacattccgtccatacggcatccgccgtatcccgggcgaagcaccgtttgggcgcgccgccattgcgcgcccgcctgaccatgtttgccgcggcatgcccgatgatcgcgcaggcattgatgatggtcatactgctgttgcacgggcaatggctgttcgccgccatgatcgcaccgggcatattcgcctgtctcgtgtccctgctgctgacgctcccctcgcctccaggcccggagaaggctcccgatccgcaacaggcaacgatcgatgtcggtatcacgggcgacgccgatgaccgcgccgcagacctccgtcatgcgccgtcgcagccgatagaatcgctgctgcacttcgcacgcctgccatggcgcgccattgtgggccgctggcttgaaccccttgaccttgcggtgccgatcggcatgaccggaagcgagccgctgatgctcgatctgaaccgtcaggggccgcatgctctggtggccggcaccactggttccggaaaatccgtgttgctgcaaagctggtgtctggcgctcgcctcgatgaacgggcctgagcatctgaatttcgtgttcttggatttcaaaggcggttccgcgttccgcaaactcgaacggttgccgcataccgtgggcagcgtatgcgatctggatctggcgcatgccgtacgcgcgttgcgtgcgctggaagccgaactgacacgccgtgaacagctgtccgccgctgtccatgcttccgatatccgcgatatggtcaatccaccaccgcgcctgatcgtggtcattgacgaattccatgccctgaaggaccagctcccggattatgtgaatcgtctggtgcgtattgcctcgctcggcaggtcactgggcatgtatctgatcgcctgtacgcagaatcccatgggtcaggtcagtgccgatatgaaggcgaatatgtccgtcagcatttgtttacgggttcgggaccgtctgcaatcatgcgagctgcttggcgatggtcgtgccgccgacctcagtccggcaatgcccggtgcggcgttctgcaacgattccgaacaggtgacggcattccgctgtgcaacggcacgcgatatcgatgcggtgtgccgccagatcgcgttcgcatcgcggttcgtcggaagcccgccgcaaccgtccctgtttaccgcgccactcccccggcacgtaaaagaccggactgtggccgaccacgcaccgcaacgcattcgatttggacttgccgacgatggcatcaacctgcgagaggcgacggtatccctcaccggtggcaatatcggtgtcatcggcccgcaggggcgcggcaaaaccacgttgctgaaaacattggctcgacacgccagcatggctgatggcttggcggtacgtgtcagttccccgcatcgtcgggtatggagctcgcaatggcttcatggcggccgctgcacgccgtatgccagctcggatgcaccaccgcctccgcatatcgtgtggttcgtcgacgacgccgatgagttgttcgacccattccgcaccgacgagcaggcgctgtctttcacacatgcgttggccgatgagtccgtcagcgtggtattcgccgtcagcacgattcgcccgatacgtataccggagcattgcaataccagaatcgtgttcccgtgcggggagagaacgtccgatcttatggccggagtccccgctcgcctattggatatgatgagtcatatcgatgccgacaacgcgggccgggccgtgctcatcgagggcacatcggcatgtctggtgcagtgcgcttcgtgaaaacttcggttttttctcggcaaaacctcttgaaaatcaccacggttcgtggttaccttggtactggacttaaggaacaacaccagccacggggcttttaagggaggcaagcaatgagcagcgcttttgattggcgagccaaggccgcatgtcgtgacaaggatccggaactcttcttcccggtgggcaacaccggtgcagcctatcagcagattgaggaggccaaggccgtgtgccgcacctgcaaagtgattgacgcatgcctgaagtgcgcactggacaccaatcaggattacggcgtgtggggcggcttgagcgaagatgagcgtcgtgcgctgaagcgccgcgccatgcgcgcccgccgttctcaggccatgcagatgcaaatctgatgttttgattatcgcttcgtcatactaggaaaccctcccgcttgggagggtttcctcatttcgggcttcgcatcactcgtcctgagcagccctgagcttcatatcaagcaccacgcgggtgccgccttcgcggcgcggctcccaatgcacggaaccaccgaaatcattggtcacaaaggtgttgatgatctgcgtgcccaaaccggaaccggaagaacgagccaatccaccctgttcttcggagccgagaccggaaccgtcatcctcgaccaccacattgaggttcgggccggagcggcccacggaaatcgtgatatggccatccttgcggccttcgaacccatgctccaccgaattggtgatgagctcggtcagcacgagggacagcggcgtggcatcctgagcgggcatcatgccgaacttgcccatgtagttgatatcgatgtgctggtctttcatcgtggctaggtccacggccatgcgcagcaggttggcgatcaccttgtcgaagtcgacgacctcgtcggcggtctggctcaatccctcatgcaccatggcaatggtctgcacgcggcgttgcgcctcctgcaattccttcttgacctcatccgacttggtcttacgagcctgaagcctcagcaatgcggagacggcctgcaggttgttcttgacacgatggtgaatctcggaaatcgtagcgtccttggtctgcagctcctgctcacgacggcgcagctcggtgacgtcacggcatagcagaatcgctccgatacggccgttgttgtcatacaagggcaacgagcgcatcgagacggcggaacggttggcgttgagttcggagtcgaccgcggctttgcctgtcaacaccaacggcagggtttccggaacagggtcgttctccttcaatagctgtgtgccgagttcgctgaggtaatggccaggcatggtggtcagcagaccgagacgcctaaagcagctgatggcgttcggggctgcgtatcgaaccacgccgtccatggtcaggatgatgaagccgtccgccacgcgagcgatatggcgttggctcatcaccgaatccttgtaggggaattggcctcgcggaatcatctcgtacagatgcttgccggcgttgatgctttccgactcatatcggccgttggattctcgtgtggccatattggtctcacgcacgaccaagcccaaggtcttgccattgtgccgaaccggcgcgtacacgttgcagacggtcgccttgcccacggttctcaataccgtggagcggaacaccacgctggagagcatggcggcgtccaattcgccgaccatgtcgtccggcatgacgtttcccaccacgtcttccgcccgcagcgtcataacggtggatggacggcattgctcggccaccacgtatttgccatcgccatcctgtaccagcagcagcagatcggcaaagctcaaatcggcgatcacctgccaatcggcgacaagatgatgcagccactcgcggtcctcgtcgtcgaagtcggggcgcgttgcaaggatatgtgaaaaatcagccatatccctatcatacgcagacgcaccgccgccgtcgcggcaagccacacgggcaagtacgacgactatgacgacatcgcatcttcaataccgcgccaatcgcgttgcacggcttcccgcccgtggccaaggtgccggcatgttgcttatcgtacacggcaagcatcacgtacagtttgatatccgaagccgccaccatattgccggcattgctgtgtccatggaacccatcatcgcgtttgcctgcgctttggtgtgatcgacgccaggacgcccggcgggaggttcaggagaagcaggggccgccggattggcctcgggctgctccaatgggcttccgcactgcgaacagaaggcatttccttgctcgttggcaaacccacactccgtgcaatacaccatcgccgagccctttattgctgcgacgttctcatcttcggattccatagtatcgccgccattgggtgatagtgttcgcgcgagtcggtattgacaagcataaaagttacgctaacgtaggttacggcagcgtaagaagcgtatcgtcaactcgtgaaacgggggcatcaccatggcatcaacaaccggcgactcggaaaagacgatgcatcacgacgctcataacagcgcgacgattgcagaggatgccaccatcgcatccaagcgtcaggcggctatcgaggcgcgcgaacaggcgttgcaggccaaggctgatgccgtacgggccaaggcccagttcaaggccgaggccattcgagccaaagccgaggagaaggcccggcacaagctcgccaaagcggagaaccgtgcgctgaaaatcgagggcattgcccctgcggaagtggaacgcaagattcgtctcgacgtgcacggacggccaaagccgttgatgcgcggctggattcacgcgattgccgctcccctgtcattggcggcaggcatcgtgcttatatgcttggcacatggcgcgagtctgaagtgggcgtgtgccgtgttcatgacagcgtcgctgattctgttcaccaattcggcctgctaccatctgggcgattggagcccgcgcgtcaccgatgtgctgcggcgtatcgatcatgtcaacatcttcctgctcattgccggcacgtataccccggtttcgtttgcgctggaaccgttctggcgcaatgtgatcatcatatcgatgtgggcgtgcacggccatcgccatcgtgattcatgtgatctggatcaatgcaccacgctggctgtatacggtggtgtacatcatcttcggcatctacggcctggcttatatggtgatgttctggaattcgccgtatgcggggccagccgtggtggtgctgctgtgcgccggcggtgcctgctacatcctcggcgccatcgtctacgccttgcgcaagcccgacccttggcctcgcgtcttcggattccatgagattttccactgcggaacggtggccggatatgcctgccatatggtggccatctacatggtgatcgtctcgctgtggcaataagcgctacgacatataagtatgcccccgcctacgggggcataccagtcacttaactcaggccagcggcttggcggccttgacagtcacggacagctcgcggccgttcggtgcggtgtaggaaacgacgtcgcccaccttggcgccctcgatggccttgccaatcggggaatccggggtcatgatgtcgtagtcggtgccggccacgatgtcacggctgccgagcacgtaggtcatctcgttgccgttgagctcgatggtcaccacagagccctcgcccacggtgccttccggagcattctcgataatcttggaatcgcgcagcttgacggtgagctcggtgatgcggccctcgttcttgctctgcgcctcacgggcggcctggtagccgccgttctcggacaagtcgccctcggcacgcgccacggcgatcttgtgcgcgatttcctcacgcagctcaccttcacgatgggcgagctcttccttcatcttgttgtatgcttcctgcgtcagcaggtagaccttgtcctcagccatatcgtcctcctgaaccgttgtcgatgctgaaacaatcttcgttatttatgacaaaacgccggctatgaccccggcgttcgtcatgtgctgacctatggtcagcgggtggaaatgatgtcgatgacgaacaccagcgtgtcctcgccgccgatgccggcctgcgggatgccgcgggaaccgtagccgtattccggcggaatggaaaccaccagacgcgaacccacgttatggcccggcacagtctggtcccagcccttgatgacctgtcccacgccgatgccgaaactggcgggctgatgacggtcgaagctggagtcgaatggggtgtccttaccccacaccacgccgtggtagttcacggtgacggtgtcgccgcgacgcacgatcgggccgtctccctcggtcagctccacaaccttgaggcccttcggggcttcgggcgtcgggaactcgataacgggcgtggtgccaaattcggcgttcacctgaggcatctgatctgtcattagtcctccttcaaagacacaatgcgccctaccttagcaccatcggcgaatcggcggtagtccttcatccctgtgcgatacgacacgctggccgtatacgtcaattccggtcatcatgctggtgaataccggacatgtcaatcagcattcgacgacattgacggcaagtccacccttggaggtctccttgtatttggccatcatgtcttcaccggtctgcttcatggtttcgatggcctgatcaagggtcacgatgtgtgagccgtcgccgagcatggccatacgcacggcgttgatggcggtgttggcggccatggcattgcgctcgatgcatggaatctgcaccaatccgcccaccggatcgcaagtcagacccaagttgtgttcgatgccgatctcagcagcattttccacctgttccggcgtgccgcctacgactgcggcaagtccggccgccgccatcgaacaggccgagccgacttcgccctggcaaccgacttccgcaccggaaattgaggcgttgcgtttgaacaggtatccgatggcaccggcggtcagcagaaacgtgaccacgccctgttcattggcgttgtccacgaaatgccagtaatagtgaagcacggcgggaatgatgccggcggaaccgttggtcggagcggttacgatgcgcccgcctccggcattctcctcagagacggccaaggcgaagagatccacccatgcggcgtcggaagactcgagcacggcgtctttgcgccggctgtcgcggcgcagcacatcggaattcgaggcgagacgccgatacattttcggcgcgcggcggggtacgtcaaggccaccgggcaatgtgggttccgccgaggtgcatccgtggtccacacaggcgcgcataacacgccagatggcatcaatatcggatcggacctggatgcccgagcgtgaagcggtttcgttggcccatacaagttcggcgatgctgagatgatgttcccggcataacgacaccagttcagtgcatgatgagaacgggtagggtgcctcgacgccgaaatcagtggatgatgactcgtccgcatcggcaaaggaggcgccttccggagggcgttcatgaatgccgatcatcgggtcttcgggagcgcctttgcgcacgaatccgccgccgatggaataccagacctgttcgtcgaccaagcttgcggcggcgtcgaacgcctggaatcgcatgccattggggtgcgcggccatgcgcttccattgttcgaacaccacgtcacggtcgtagtcgaaatggatgcgtttgaggccggcgaggttcagagtatcatccaacgcgcagatctcgcggatgtgcatcatgtggtcggtatccacggtggccggcagattgccttcgagcccagccatcgcagcacgatcggtgccgtggccgagaccggtcagcgccagagaaccataaagcgtgattttgacacgtgcggtgcgatcgaccaaatggtcggcctgcaacgaggaggcgaaagcatgtgccgcgaccatcgggcctacggtgtgcgaggatgaaggtccgacgccgatggtgaacatgtcaagcacactgaacatttggctccttctcccctgctggttcggcatgccggtgttaccaggcgtcataccatcacgatatcgtatcccagcccagcgcccggaatcgctttcgccttgtgcgatgatggccgcgcgcgtcatgccggcgagcgataagtcagtcagtgagacagtgcggagaacatcatgaccagtacgatgataccgatgatggccaatacgatctgcaccaccatcagcccgatggtcagtcccttcttggtggcgattttgggcgcgtacgcctgtgccaacaggaaggcgatgaagccgaacaccgcgtagttgacggtcagggccatcacatcgccgttcgacaacaccacgccgttcagcggctggttcagcgtgttcatcatcgcgctcatcacgaacatgccccacacgccgtagccgattaatccgacgacgccgtacagccatggcttgagtttgtcgttggcacgcagggtcagggcttcggcacaccacaacagggcgaagccgacgatgtaggtgaacgccacggcgatcagtatcacgatagtcgcccatggcaggagtgcggccacattgccgatcatggacagatagaatcccgagcaggcgatggcaccaacggtgagtgcagtgcccgcaatgacggcttgggcaagcatggtgggcagtgcgccttgttcgactcgttcgacatcggtccagcgtgaagccatgtggattcctcgtttcatcaggtacatcgtcacaacgccacatagcctaacggccttttgtttcggccttataagctctccacatagtgagctgcgagccccctctgacgaggggggctgtcggcgaagccgactggggagagaccacggcacagccgcaaaaacggcatcggccacaggccgatttcaaggtgcctccggtgggactcgaacccacaagccgaagcgatcgattttaagtcgactgcgtataccatttcgccacggaggccaacttttctattataagctatctcctgccctgagcattgcttgcgggttgctgcgcttcgtgcagccgtcgcggcatagccgctcccttcgcctacaaacagcccaccgggctgtttgcttaacggctcagcccgctggaggcacttaccacttacgctattgagccagcaaccggcgaccataatcgagcacaatgccgtccagcagaccgtgttcgctggcaacgaacgaatcgatggcttcaccatgatcggccttggcggcttcgctgacacgcgccagcacacggctccagaccacagcgccgccgccgaccacatcgatacggccggggtggatggtcttgtattcgcggcgctcggcgcgcgtcatcctaaggaacttgtcgtccacggcataggcgtcttcaaggctcagccgatgcccgtcgaccacggtgtgatcgtattccttcaatcccatggccaaggcggtcatcgtggtcaccgtgccggacacgccaatgatggtacgggccttgcctgcgtccacggtgcggaaggcctcatcgatatgttcatcgacgtccacaacggcctcatcgatctgtgtctgggtcggcggatcattggtcagatgacgttcggtcatgcgcacggaaccgatgttcatggaaaacgcgccctgaacctgggtagtgggcgcactgacgccgtcgccaccgatgaccagctcggtggacccgccgccgagatcaaccaccagatagggggcgggcagatcgtcgcgattgaccacggaagtggcaccaaggaagctcaggtcggcttcttcggtgccgggaatgacttcggggcgcacgccgaggatacgttcgatctcatcctcgaactcctcacggttttccgcgtcacgagttgcagaggtggcaacgaaacgcaggccgtcgatgggatgttcggcaatcacaccggcgaattcccgagcggccacataggcgcgttccaacgcttcgtcggcaaaacgatgggtcttgtccacatcctggccgagacggatcacacgcaggatgcgcggcaccacctcatgcatgccatcggcatcgacacgtgcgattttcagtcgaatggagttcgtgccgcaatcaatgccggcgacggttacggattccttgctcattgccttctcctcgtatcccttagtgcgtatgaatggactgttcgcactggctcatctgttgatcaatcgtccagcgtgcagcggcagacggtcggatcgaattcgtctttgacgcgttccagtaccaaatcgccaatggggttgacgcccggccccataaccagggactgggccagcagggcatgcaggcacttgacgcgcaccggcatgccgccggccgaagtgccttcaatatgctcctcactgtcgccaagacgtcctgccagttcgtggcggaatgccagatacaggttatgggcctgctcatatgcggccttgagctcctcgtccaaggccaacatgtcgttgtattgctgcatcacgccggcggcctcgacatgggaggcggccttgacggcttccggaccggtcagatagcacgtggtggggaaagggattccgccgggcaacaccggacgggtgattacggcaagtggcctaccgcagacgcatcgcgcccccacggcgaccatgccgcgcgggtatcggccgagctgacgctgcaccaggtcgatgtcatgatcgttggcgggctcggcaagcacggtatcgacaagggccttggccttggcggcgatatcgatggtcactgttgggttccctcccctgtgttctgttgggtattctgttgggtgttctgatcggattgggtgttctggtctgacttatcggaccgcttggatgagtcgttggatgacgagtcagaggaaccggaaatatcggatttgccggactcgctatcggtcacaggctcatcggcctttttgagcgagtaagacagttcgctgtaccatggcaggacttttttgttgctgctactggaatcttccgttttctgggattcgctatcggagccggtcacggcttcgggatgaagcacacgcacggcctgttcgccggggaatacgaagccgaggcgttcacgggcctgggcggtgatgtaggccttgtcatcccaacgcttgatgtcgttttccaactcctgcttttgggcaatcagcgaagcctcctcacgcttgagaccattgagttcggccaggttcagggcataggtgtggaaggtggagaccagctggatggtgccaagggcgataatgaacagggagacgaagaacgctataggccccgccgacccttttttcctaactcgtgctttgccggttttgccaggtttgccggtacgggacgacttgctcatgtcacacgaaaatacccgccgcattcgacttgacgaatacgacgggtatcgagcttcagtggaaactcacgcctttacgggcgtttcagctcacttggccaggtacttcttgcaggccttgaaggcgctgtagccggcgtactgagcggtggagccgagctcctcctcgatctcgagcaggcggttgtacttggcaacgcgctcgccacgggccggggcaccggtcttgatctggcgggtgttcttagcaacagccaggtcggagatggtggtgtccggggtctcgccggagcggtgggaaaccatggaggtgtagccgttggcggtggccagctcgatggcgtcgagggtctcagtgacggaaccgatctggttcagcttgaccagcagggagttggcggcgccgaggtcgatggccttctgcagacgagccgggttggtgaccagcaggtcgtcgccgacgaactgcagacgatcgccgaggcgagcggtgatggcagcccagtcttcccagccttcctcgttgaacgggtcctcgatggagacgatcgggtactcgttgatgaggttctcgtagtagtcgagcatgtaggcggagtcacgctcttcaccgtcgaagcggtacttgccggtctccttgttgtagaactcggaggaggcgacatccaggcagatgccgatctgcttgccaggctcgtagccggcggcggagatggcgtccatgatgtacttgagggagtcctcgttggacttcatcttcggggcgaagccgccctcgtcgccgaggccggtgttcaggccttccttcttcaggacgttcttcagggtgtggtagacctcaacgccagcgcgcagagcctcggagtaggtgtcgaagccgtacggggagatcatgtactcctgaatgtcggtggcgaagtcagcgtgagcgccaccgttcatgatgttcatgttcgggaccggcaggatgtggccgttggtgccgccgatgtagcggtacagcggcaggccggcggactcggcggaagcgtacagagcagccagggagacgcccaggatggcgttggcgcccagcttgcccttgttcggggtgccgtcgagctcgatcatcaggtcgtccagagcgcgctggtcagcagcgtccatgccgatgaccttcggagcgatgacctcgttcacggccttgaccgcgttaagaacacccttgccgccgtagacggacttgtcgccatcgcgacgctcccaagcctcggcctcaccggtggaggcgccggacgggaccaggcccaggccctgggcgccgtcttcggtgtccagaacgacctgaacggtcgggttgccgcgggaatcgagaatctgacgcgcgtacacgctttcaattactgccacaactactccttaaaacggttgtgtatcttgaatgacattcttaagagtagtgcgatttgtggacgttgtgaacaacacgcccaaaatttagcgttagcgctcacaatgccagtgtgccgcctgattgcaaggcagtacggacgaaatcgctcagtcaacgtccttgccattgaggtagtcgatttcactgtcggacaatttcagttcgctggctttgaacgagtcctgaatctcctgcgggtttctggccgagggaatcgtgaacagatattggtattgtgcaagttcccacgcgagcgtgacgcgctggtaggagcagtcgtgaatcttggcgacttcgcggaaccggtcgaacagatgctcgttgaacgggtcgaggaatccgccgagcggcgaccagcagacgaaagccaaaccgagcttttcgcaggtttccaacgtgtgttcagggtcgcggtggaccggggagaactggttctggacggccacgagacgatcgcccaaaatattgcgggcggtttcgatgtccgcgttgtcgattctggagatgccgacagctttggccacaccttcgtccacgagctgcttgagtgcgcccatctggtcttcgtacggcacctgcggatcattgcagtgcgagtagagcagatcgagcgtatcgacaccgaggcggcgggctgattccttggcattggcgatcatggtttcaggtcgggcgtcggcctgccagccgtagttgccgttgccgtcaagcgtgcgcagccagccggttttggtggctacgagcacctgatctttggggccatgccacgagtgcagagcatcgcggaccagatattcgccatagcccatatcctccggttcgccggtgccgggtgcgctgggcagataataggaccaagccgtgtccaaataacggactccggcatcgagcgcggcatggatggtctcgattgcctgatcacggttggaggggcgcccctcgatggcgagcgccatcgtgcccatgccaaggcggggaatctcatagccggcaagtgttgccgtggtcgcgctctggttcgtgcggctcgtagtcgtttcgctcatagcagtcacttaatctcgctcgctggacagtcggaacgattccgtctggggtgaatcatcgtcacaaacgacggcatgaatatgaatatggctcaccggaggttgcccggtgagccatagctggctcgactgtcgcctcgcaccccgtctacaaacggctctgccgtttgcttgatgacggggtccatgccaaatcatcaagtaactggttggtccagaggactacctggtcggagctcatggggccttggcctagggagccggtgaacggggtggggacgatgagctggtgggtgaccggacggtattgggtgcctttgtaaatacggcccatacgcatctggatggattcgggcgggtcgatgcgaccgatgcgcacgcggttggattgcgcgagaatctccgaaatgccgagcttgcgggccttgaacttcagacgggccacgtcgaacagggtctcgaattcgaccggcggcttgccgtaacggtcggtaagttcctcttccaaatccttcagatcggcctcgttgcgggcggaggcgagcttgcggtacgcttccagacgcagcttgtccgaatcgatgtactcgatcggaatcgacgcttcgatgggcaggtcgatggacacggccaccggctcgacgttctcttcgggctccttgtacttttccacggcttcggacaccatgcgtacgtacaggtcgaagcccacgccctcgatatggccggactgctcgtcgcccagaaggttaccggtgccgcgcaattccaagtccttcatggccacatcgaaaccggagccgagcgccgtgttctgcgcgatggtggcgagccggtcatgggactgctcggtcatcggcttggacgggtcgtacaagaagtaggcgtacgcgcgctcgcggccgcgaccgacgcggccacgcagctgatggagctggctcaagccgaaacggtcggcatggtcgacgatcagcgtgttcgcattggagatatcaagaccggtctcgatgattgtggtacacacgagcacgtcgatgtcgcgatgccagaagtcgcggatgatctggtcgagctgcttctcccccatcttgccgtgggcgatgccgacgtgcgcctcgggcaccagcgtgtggatcttgtcggcgatggacgagatgtcctgcacacgattgtggacatagaacacctggccgcctcgcagcagttcgcggcgtacggctgcggtgacctgcgcatcctcgtaggcgcccacataggtcagcaccggcaaccggtcttcgggcggggtggcgagcgtggacatctcgcgaatgccggtcacggccatttccagcgtgcgcgggataggcgtggcagacagggacagcacgtccacattggtgcgcagtgtcttcagcgtttccttgtgttccacgccgaaacgctgctcctcgtcgatgatgacgagtcccagatccttgaacttgattttcgggttcagcagtttgtgcgtgccgatgaccacgtccaccgtgccggtttccagaccctcgacggtctcgttgatctccttggtggtctggaaccggctcatggccgccacattgaccgggaaaccctcgaaccgttcgctgaaggtctcgtaatgctgctggaccaacagcgtggtgggcacgagcacggccacctgcttgccgtcctgcacggccttgaaggccgcgcgcagcgcgatctcggttttgccgaaccccacatcgccgcagatcaggcgatccatcggcacgggcttctccatgtcggatttgacctcgtcgatggtggtgagctggtcggcggtttcctgataggggaaggcgtcttccagctccttctgccatggggtgtccgggctgaacgcgaagcccttggcgcgctggcgggcggagtacagcttgatcaggtcgtcggcgatctcgtggacgtgcttgcgggccttggccttggtggccgcccaatcggagccgccgagcttgttgagcttgggggcttcggcaccgatgtatttgctgacctggtcgagctggtcggtggggatgaacagtttgtccgccggggcgccgcgcttggaaggcgcatattcgatgaccaggtattcgcgagtggttttgttggcgccggtgccgatggtgcgctggcgcatttcgatgaaccggccaatgccgtgctgctcgtgcaccacgtaatcgccttttttgagttccaccaagtcgatggccttgcgccggcgtttcggcgttttggccacggccacggccgaagtgcggccggtcaggtcgcgttcggtgagcagggcgattttggcggctttgtccacgaagccgtcgatggcctgagagcggatgacgtcgaaattggcgatgccggtagtgttgatcgcgcgcttgagtctggccaaggtgccggccgcagcggcggtgatggtgacgtggaagccggcgtcgagcaggccttcgatgccttgggaggccttggcctcatcccctcggaattcggccgggttctgggcgtcgagctgcacatggccggtcagcgtggtgtccacgccgaaactggtgaggcgaatcaccggatgttcggagtattcgagggagctgatggtttccgcatagtcgaggaagctggcttcgtcgaagctgatgggcgcgccggcgccgtggccggaagcggccacatgccagctggcggccaggaactcgttcgcggtttttgccaagtcttcggcggaacggcgcagtttctccgggtcgctcaggaggatcacggcatgcttgggcagcatggagcccaccggttccagatggtccacgagcgcgggcatcagggattccatgccttcgaccggaatggcgttggcgatggattcgagcatgtcctcagcattgggaatcgaaccgaccaaggctttggcgcgggcgcgcacggcgtcggtcagctgcagttcacggcatgcggtggcccagatggtcttgaggccgtcgccgtaggtacgctgatcggaggcgtggaattccttgatggtgtcaatttcgtcgccgaagaattcgatacgcaccgggtgcggtgcggtgggcgggaacacgtcgaggatgcctccgcgcaccgcgaactcgccacggtccatgaccagatccacgcgcgtgtaggcgttttcgatcagacgtttggcggcttcgtcgaggggcaggtcctcccccacggtgaacacgagcggctcgacgtcgcccagtccttggacgaccggctggatgagcgagcggatcggcatgacgagaatgcgaatcgggccgaacatcgaatcggtatcgctcggatgcttgagtctgcggaacacggccatgcggctggccacggtgtccgcgcgcgggctcagacgctcgtgcggcagggtttcccaggcttcgagctgggcgatgtcgttcgggtcgccatcataccaggagcgcagcgagcccacggtctcttcggcttcgcggccggaggccacgaccagcacgaccggcttgccgggtttgccggccacaccctggcctatggcggcggccaaagccgggcgcaagccttcggaaacaccggccaggacggagttgtcgacgtcgtccgaaacctcgatgtcgccagtggcgagcctaaggaaggtcttgtcctgttccagcccggacaggatgcctaccagtgagccgttgatcaggtccgggtgcgtcgcctcaccggccattgaacttctcctgggtcttggcaagaccgtggaagatgatgtcctcggcggcgtcggcgccgtcagccaggaattcgggcagctgcttgcgctggtccgggccgaagccgcccagtacccagttcaccgtgttgtcatgcgcgttcgcaccgcgcttggagtggccgacgcccatgcgcacgcgcgcgtatttcggcgtgccgagggaacggtcaatcgacttgatgccgttgtggccgcctgcggagccgcctgccttgaccttgatacggccgaattccaagtccatgtcatcgtgaatcaccacaatatggtcgggctcgatctggtaataggcgctaatggaagccaccgcattgccggaatcattcatataagtcagcggcttggccagaaagaacttgacggtgcggccgtccaggttcatcacgcttttaccgagcatggccaagcccttgtgatcggcgaagttcaccgtccaacgttcggcgagcacgtcggcggtcatgaagcccatgttgtgccgcgtgtcctcatattttttgccggggttgcccagtcccgcaatcagccagaaatccgatgccataatccgctcctcgtccgtcttcctttattcccgtatgcacgttctgtacgttccgtacgtcatgcgcgcgttcgcctcgcgcactggcccatgcccggccggatccaaccgtcaagattgtactcaacgccgccgtcaagctcgtttgctccggcatcctcacacttttcttgactgaaatgacttactgcaaggctacaggtccaaataccagtaggacatgtcccgcatggtgccggtggagtcggtggcagcggcgggcatgagtccgaattgggtgaagccgaagcggtgcatgagggcaatggagccggcgttatcggcgaaaatgatgccgcaggccttgcgcatgtggcgggccagcgcctcggtgagcagcctgtcaagcatgaacgtgcctactcccctgccttgccatgccggatcgatgtaataggccaaatcggtgacaccgtcatatcctgcgcggtcatagaacacggagagcgcaccgaagccaatgattgaaccgtcttccgattccacaacaaaaacgccgtagggcggcgtatgggattcgacccaggcgcggcgttggtcgaaggtgcgcggggtgaggtcggcggtcgcaccgccggccatcactgaggcgttgtagatgtcggcgatggcttggacgtcggattcgacggccggacggaaggtgtatggcatgaggttcctttgaatacgcaaatagcccgtccttatgataaggacgggctatgtcagttgaggtaaccgactcccttcagtcgccttcggcgatagctcccctcaccctgagggaagccaagttacttgtcgagctcgatggccttgttgagggcgtcttcaagctccttctgcgccttgccgtaggcggtccagtcgccgttcttcatggcggactggctgtccttcatggcttgggcggcatcgttcagcgcctgctggagttcggggctacggtcggaagacgagccggaatccgacttgccgtccgtggtgccggactggccaccattggtatcggaaccagattggtcaccggatatgccggacgactggtcaccagacgatccgtcaccggacacgttctcggcatcgcctgcggccgcgccggaatcaccaccgaacacctgatccaaggcctcatccaacgtatccgcaaatcctacctgatcaccgaacgcgaccagcgtcttcttgagcagcgggaatgaagtcgcacccgaagacttgacgtacacgggctgcacgtacaccagtccgccaccgagcggcagggtgagcaggttgccgcgcaccacttgcgtgtcgccggattgcagcaggttcagttccttggacacgtcggcgttggcgttgaagttgttctgcgcctggccggggcccggtacgttcgaatccttgggcagctcctgcaatcggatggtgccgtagttcgagcctatcttgcccttctcattgccggcatccgagtcgaccgacaggaagccggtgaggatctcacgggtggactggccagccggaatgtaggtggaggtcagcgagaacaccggttccttggtgccaccggtctgcaaggtcaggtagtacggcggctgcaggatgtcctggtcctgctgggactgggattcggtcgggtcgaccggcgtctgccagaagtcctcgccggagtagtactggttggcggaggtcacgtggtacttggagagcagctcgcgctgcaccttgaacaggctttccgggtagcgcatgtggctcatcaggtcgccggagatatcggagagctggtggtactggccggggaagatcttctcccatgccttgattaccgggtcggattgatcccatacgtacagatccacggaaccgtcgtaggcgtccacggtggccttgaccgagttgcggatgtagttggccttctgcgagcccaaggatgagaccgttgcggaagagacggtggtggaatccttggtggcggagccgaggtcggtcatctgcgagtatgggtaggcatcagaggtggtgtagccgtcgacgatccacttgacgcggccatcgaccacggccggatacacacggccgtcaagcgtcaggtacggcgccaccttggccacgcgctccttgggggaacgatcgtaaagaatctgcgattcgctggtcacacggtcggagaagagaatctgatcggagccgaagcggatcgcgtagagaatacgggagaacaggttgccaaccgaggggccgccgtcgcccttgaacgtggtcagggcgccttccgaaccggtcgggtagtcgaactcccaagcctgcgtgccctccggtgcgccgacgatcgagtattcggtggtgttcggcgagaagtagatgcgaggctcatacttttcggattcagtgagcttgccctgagtggggatgccggattcgaagaattcaggctggccgtcggcggtcaccttgttaccgtaagcggccaccacgccgtaaccgtgggtgtacacggtgtggtcattgacccaattgcggttgtcgttgccggccagggcaagctcgcgggcggcaatcacggtgtcctgggagacgccgtcgatctcgtacttgtcgactgccaaagtgtcggcgaaggtgtagtactgcttggactgctgcagctgtttgaatgtggggctgacgacctgcgggtcgagcagacgaatctgcgcggtggtgtcgccctccttggccagagcgccctgctcgcccttgtcggtcaccttgtattgctcggtcttgagcttgtcaagaccgtaggcggcgcgggtggcgtcgatattgcgctgaatgtaggtggattccatctcctgtgcgttcgggttgacgcggaagcgctgcaacagcaccggccatgccacggtgagcacaagacccaccacgaccacgacggcaatggaggtcaccggcacacgccaggccttgagcgcggcggaggcgcgcacgccgatggacgcctggccttcgagcgtgtgggaacgcatgagccagatgcccagcaccacgccgaggatggcggtcagcgcggccatgatgaaggtgacggggatgttggcatgcacggcggtgtaggaggcaccggtgatgcgtgaaccctgcacggtgagctggtcgaagacgccgatcatctggcgcactgcccaagcgaacatgttgagcatcagccagatgccaagctggcgacggcaacgcttggtgatggagaacaggccgcgtccgttaaccggcatagtaatgcggataccacccatcagcacatgagtgaccacggaaaacacaaggcccacgcccagcagcatggccacggcggcgagcacgagcttcaggcccggcagcacgaacacgtagaagccgttgtccagaccgaactgcggatcggtggtgccgaacgactgcgcgttgaacatgagcagaatctcgctccagttcgcgttgaactgagagccgaagatgacgccgacgatcagcgaaatcaccacggccacgcggcgagcggttttcgagctgacggatttgccgacctcgaccacatcgccgttaatgcgaatggtggaaccgtcggccgaatcagggcgtgctcgaatggccagccaggcggaaacgaagccggtcaaggccatgagcagcgcgtaggccacccacagaccgattttcaccccgagctgggtccagaccacggactggaagccgagctggccgtaccacatcagatcggtgatgaatcgggacaggccgaagaacagaccgacgatgatggccaaggccagcaccacgccgatcagaatcttgctgccacggctgcctcctgagccaccggacgctggcttacgggtgatacgcggattggccgagccacgtggagggcgggatgacccggaggggccggcgttggtgttgcgggccggaccgtccccatcggcctcgacatcgaggatgatcggatcgtcattgttcgcattgttgcgtcgtgaatcgccgccattgccgaacagtattgagaaaggatcgttaaaagacataactcaagcctatcgaaagggcgggaggtaggttatgccctgagcacagaatgaggcagcgttctgttctacgctccgttctacgcttgccggtatgaacagccaacggccacaacatatgcgtccctcagcacacgccacacgccaacttcggcacaggagcactccaatcgtggcgacaatatgtgctttggcagtggtgttggccggcgtggcagcctacggatggcatgtcggatggttcgccaaatccacatcaaacggcaacaccaccactccccagacctcccagacaagtgcgttaccacgcgccgacgttccttccccgaagaagaacgaaccggccgcacaagcccaacgtgcggtatccgccatgacacttgaggaacgtgtgggacagttagtgatggtgccgttgcttgccggttccgatccctcctcgttggcttcaacaatcgccgatgagcacattggctcggccattctcattggcaattggaataccggcgccgatacggtcaagaccgcgaccgcgcaactccaaggatatgcgccggccggcaatcgtctcatcatcgccaccgatcaggagggtggtcaggtgcagcatctgactggtaccggtttcgacacaatgcccagtgccgttgagcagggcacaatgtccgctgacgcattgcgtcaatcggcaggcacgtggggttcgcaattagctgctgctggcataaatgtcgatttggcaccggtgctcggcacggtggtgggcgatcgtgcctcaaatgctccgattggcgcgctggatcgtgatttcggattggatgcggccggcaacgccgaacatggcatcgccgttattgaaggtttgcgagacgctcaggtcggcgcggcggtcaaacattatcctgggttgggcgcggtaagcggcaataccgacttcaccaccgaaggcattctggatacgaccaccacgttgggcggggccgaggcaggtgcctttgaccaggcgatcaccaagaccgatcctgcgatggtgatgatgtcgttggccacgtatcaatccatcgacccgaataatccggcggtgttttcttctacgattatcgacggtcatattcgcaacgccctgaagtacacgggcgtggtgatttcggattcgatgtctgccgaagcgttaagcagctacgatgcaagccaattgggagtaaagcttgtcgaggcgggcggcgacatgtcctgcatcggtcagacggattacgtaaagccaattgtggacggcctcaacgaacgggcgaagtccgatccggctttcgcttcgaaagtgacggcggcggcgactcgcgtaatggcattgaaaatcaagatgggactggcctgactgcttatcctttgcactggtgaggattgatgcgcactgattcgcgctaatcctcaccagccctcgtacaaatgcacactagtcctcgtacgaatcgtcagtcctcgtatgaatacagaccatgcttgccgatgtattgcaccacgccgtcaggcaccagataccagaccggctcgtcgtgttcggcgcggcggcgtacatcggtcgaagagatggccaaggccgggatctcaagcgtatcgacctttccttcgggcaaggtcacgccgtccggactggagtagccggggcgcgtgacggccacgaagtgggcgaggtcccacatgaggtcggcgtccttccactgcataatttcggccacggcgtctgcgccggtgatgaagaacagctcggcgtcgggatgttgggcgcggatatcgcgcagggtgtcgatggtgtaggtgacgcccggacggtcgatgtcgacacgcgagacggtgaatttggggttggatgcggtggcgatcacagtcatcagataccgatcttcggcgttggtgacgtgcttgtccagcttgaacacaggtcggccggtgggtacgaaaatcacctcatcgaggtcgtatacccaagctacttcggaggcggcgaccaagtggccgttgtgaatcgggtcgaacgtgccgcccatgatgccgacgcgcaggcgcgtatgccagttgccgcgtgcggaaagcctgcctttgccatggctgctggccccggccggcgcggacaggtcagacatgcgccgttcggtttcgccttgggtgacggcaacgatttcggcgggctcggcggattccactgatttttcggactgaactgacgcagccgttttgtggctgtcggtaacaccactcatgcctggccgccctcgccggcggcgtcatcggctgattcggtttcctcttcgatttcgccggcggtgggattgtcttccctgggatcgatcttgcccatgtcttcatcccattcgtcctggaccacgcgacgaatctcggcgaaggtgggcagcgggaagtccggctggtagaggcggcggacctcggccacacgctcggtgatgcggatgagcgtgtcggtcatgccgtcaaggtcaccgtcgtgctccatctggctgtatttgccgatgtagccttccatgagctccatgtgttcgcgcacgatcttgagctgggcatcgtcgaggtccgcgacttcgggcgaatcggtctcgggccaaccgatgagcacggcgtccgcgtattcgagcgacgcacgctgggcggcggaggcgatgccgtcctcgatctgcacaaggaacacgtagcggacgatgctgagccgttcggccgcgatcttcaggccgagcttgggatcgttgaggtcgatgtcgggccgcagttcgcttgccttgtttgccgtgtcagccgtaatgttcatgttgccgtcctcgttcatgcgcgcacctgtcctgttccgtaaccgatccacttggtggtggtcatctcccgcaatcccatgggaccgcgtgcgtgcatcttctgcgtggagatgccaagctcggcaccaaagccgaacacgccgccgtcggtgaagcgggtggaggcgttgaccatgaccacggccgagtcgatgcgcttggtgaattcctcgatggccgcataatcctcggcgatgatggattcggtgtggcctgtggaatgcgtgttgatgtggtcgatggccgcgtccaggtccgacaccaccttgatgcccattttgagggccaggtattcggtgtcccaatcctcttcggcggcgtggttgaggtcaaggccctcgattgccgcgccggagatgatgccgtacgacgtggtgtcggtctgcagcacgacgttcgcctcggccagagcggcggcgatctgcggcaggaattcggcggcgacatccttatgaaccaatagcttttcggcggcgttgcacacgcccacgcgctgggttttggcgttgatgatgatcgggatggccttggcgagatcaccggacttgtcgatatagatatgcacgttgccggcaccggtttcgatgaccggcactttggagttgcgcacgacggcttggatcagacccgctcctcctcgcggcacgagcacgtcgatatggcctcgcgcctccatcatggcggtggcgccggcgcgcccgtactggtcgacggattgcaccagtgcggattcgaaaccgtgggcttcaagcaccggggcgatgacgcccaacgtggcggcgttagtgcgttcggcggcgtggccgcctcgcagcaacgcggcattgccggacttgaggcacaggctggccacgtccacagtgacgttcggccgggcctcgtagatcatgccgatgacgcccatcggcacgcgcgtctgggtaaggcgcagaccgttgggcaggttgtatccgcgcacgatctcgccgaccggatcgggcagggtggccacatggcgcacgccttgggcggcggcggccacgcgcggcacgtcgaacagcaggcggtcgagcttgcccgcatccatgccgttttccttggattcgagcatgtccagcgcgttggcggcttcgatgtccgcagcatgctcgtccaacgcgtccgcaatggcaagcaacagttcgtttttggcttcggtatttgcctgtgcaagacgctcctgtgcgcgtgcggcctgatcggcctggcggcacaccgcgtcgaacacctcaggactcaattcatcgctcataaaaaacaagagtaacccacaatgggccgcattgcccgtttcgacccatattgcaccgaagatagccggggatataagcgcggctccctctgatgagggagctgcgtacatccgcaaaaaatcagtgaatctggtccaggtcggggtagagcgggaagtcttcggcgagcttgccgacgcgggccttcagcgcggtcacgtcggcggacgggccggcggcgagcgcggtgccgatgatgtcggccacctcctcgtattccttcggtccgaagccgcaggtggccagggcggacgtgccgattctcaggcccgaggccaccgaggccgggcgcgggtcgaagggcacggtgttgcggttgatggtgatgccgcaggcggcgagcagatcctcgccctgctggccgtccatctcgctgttgcgtaggtcgaccatcaccagatgcacatcggtgccgccggtcagcacgaagatgccgttggccttgacgtcgtcggccagtagtcgttcggcaaggatcttggcaccgtcgaacgtgcgctggcggatgatctccgggtcgatgcggaaggtctcggggttcacgccgtacgcctcggcgtggtagaaacggccggggtagccttcggcgtatttgttggtcagcacggagccctggcattgcagtaccgctcgcggcacgaagttctcagaggcgatcatctcaaggccactgcgctggcggcccagttcggagtccagcagttcggcgatctcaggatcggtttcgcagatcggcgcgttgaaagcatcggttgccttctgcgcaaggggtgaagcggtcatgggtgctctttggtataagcgacaattgattcgccgttgtcgccttaccgtatggcccgtttgcagccggcctgtttcatgatatggccggtccccgttcgatggcaatggtgattttcgccggtgcgaccggtcggttatgcgagacggacggcccttctgcccacggcccacgctagactgatgtggattcatcatccctttcaggcagaaggattcatcgtgacaaccaccttccattccacccgtagcaccaccgattcgctgaccgccaagcaggcgattcgtaagggcatcgccgatgacggcggcctgttcgtttcggacgcgttgggcaagaccaaggtggacgtggcctccctgccgggcaagtcgtaccagcaaatcgccgccgaggtgctgggcgcgctgctgccggacttcacggccgaggagctgggccagtgcatcgccgacgcctacggcgaacagtggtccgacgagcgcatcaccccgctcaagcccctgggcgacgattacgtgctcgaactgttcaacggcccgacttccgcgttcaaggacgtggcgctgcagatcctgccgcgcttcatggcgcacaccacgccggccgatggcgacgcggacgagaagatcatgatcctcaccgccacctccggcgacaccggcaaggccgcgctggccggcttcgcggacgccccgggcaccgcgatcaccgtcttctacccggaaggcaaggtctcccaggtccaggagctgcagatgaccacgcaagccggctccaacgtgcaggtggccgccgtggaaggcaacttcgacgacgcccagtccgcggtcaagcgcatcttcggcgaccgcgccctggccgagcgtctcgccggcaattcgcacgtggtgctttcctccgccaactccatcaacgtgggccgtctggtgccgcaggtcgtctactacttctccgcttacgcccaactgctcgccgaccaggtgatcaacgtcggcgatgaggtcgagtttgtggtcccgaccggcaacttcggcgatatcctcgccggctactatgccaagctgctcggtctgccggtcaagcacctcgtggtggcttccgacaagaacaacgtgctgttcgacttcctgaccaccggtacctacaaccgccagcgcccgttcttccagaccatctccccctcgatggacatcctcatctcctccaacctggagcgcatgctgtactacttgtccgagggcgacacccgtctgatctccatgctgatgaacgacctcaacaagtggggcacgtacgagatcccggaagaactgctggccaagattcgtcagatcttcggcaccggttgggccgatgaggatcaggtacgcgagtccatcaagcactgttgggacgagaaccactacgtgatcgacccgcacaccgcctgcggctactacctgcttgagcagatgccgcgcgacccgctgaccccgcgcgtgctgctctccaccgccagcccctacaagttcccgcgcgtggtgaacgaggcattgggcttcgacgccaccggcaccgacttcgagtgcatggatgtgctggcccacgagaccggcaccaccgccccggccgccctgcgtggtcttgagaccgccgacgtgcggttcaaggacgtcgtggccatcgacggcatggaggactacgtggagaaggccgcccaggcgctgtgatagtccgctgacggcactaactgacaattcccaaccgatacatgctttaccagcatgtatcggttttttgttttctgatgtcacaagtcgaaggtccaggcatgttcaagcatgtccgagccttgtcacgcgcggctttcttgcggcttttcacctgcaacgagccaatggcgtgttgcttgttttttctaggaaggcgggaatcgccatgctgccggcgaacgggaaaatccatgtggtttgttaggttctgtttctgcaactgaatagtcccatgagggagtagacagcattgcggcgaagggctcggcccaaaccgcaatgtggcaagtcaacatcgtggccgtcggcagttccgttacggtctggctttgccttaaatgacgagactcatgtaccgcggagtatgcgatacatggtcgtcaacgattcgtttggctgcgtgccgccatgttgcgcggtacgcgagtgatattacgcgggtttcagtgcggtgtgtcaaccaaacgagaggaacatatgaccacggccaacgggcagacgcccgcaccattcatgcaggatgcgccagcagtcatcagcacgctgggcaccgatgcacatcaaggcctgaccagcgaacaggccgcgcacaacctgaaccagtacggtcccaacgccttcaccaagccgaagccggaatcgatgctttcccgcatcgtcaagacggccgccgacccgatgctcatcatgcttatgatcgcggcggccatcaccctgggcgtcaacatcacccgcgccatggccggcggccacgccgacattctcgaatgcgtgggcatcttcttcgccatcgccctgtccgtgacaatcaccgtggtgatggagagtcgcagcgccaaggcattcgaagcgctgaacgacatcaatgacgacacgaccgtcaccgtggtgcgcgatggcgaggtcacgctggtgtcgcagcgagacatcaccatcggcgacgtactgcagatcagcaccggcgacaagctgccggccgatgcgcgcctcatcgaatcgaacgatctgaccgccgacgaatccgcgctcaccggcgaaagcgtgccgagtgccaaagccgccgacgccgtgttcaccgacccgaagaccccggtggccgaccgcacgaacatgctgtattccggctgcttcgtgaccgccggcaatggccgtgccgtggtcaccgccgtgggcgacgacaccgagttcggcaagatcgcccgcgaactgcgcgccgccaacaccggtatgacgccgctgcaggagaagctcgcgaagctcggcaaggtgatcgccgtggtgggctcgattgtggccgcactggtgttcgtgcttcaggtgacccggttcgtggcttccggcaccgtctcgttcgacacgatttccgaggcgttcatcacctccataacgctgatcgtggccgccgtgcccgaaggcctgccgaccatcgtggccgcgtgcctcgcggtgaacatcatcaaaatgtccaagcagaacgcgctggtcaagaagatggtggcgtgcgagaccatcggctgcatcaacgtgatctgctcggacaaaaccggcacattgacccagaaccgcatgaccgtgatcgaggcgtacaatgcaccgggccgcgccttggagaagcccgagcagatcaggaaccgcatgctgctggagaacttctgcgtcaacggcaccgccgacgtgaccttcccgggcgccaccgaagccgaggccggcgcgatgccggaattcatcggcaaccccaccgaatgcgcactgttggtcgccgcgcacaagaccggactcgactaccggattcgccgcgagcgcgcgacggtgctccacacgtatccgttctcgtcggagaccaagagcatgaccactgtggtgcgtgacggcgacggcattaccgtgttcgccaaaggcagcccggagaagatgctcgacctgtgcgccgtcgacgccaagacgcgcggcgaaatcgaacgggaaatcgcgaagttccaggcgcagtcctgccgagtgctcggcttcgcccaccgccatatttccgataaggacgccgacactgcggctctcgattacgctgccgaccgcgccggcttggaatccggcatgatgttcgacggcttcgtggccatcgtggatcccctgcgcgaggatgtgcccggtgccgtggagcgctgccgcaaggcgggcatcgagctcaagatgctcaccggcgacaacatcgtgaccgccacggccatcgccaacgaactcggcattctggacgagcggcatatcgccgtcgaggcgcgccagatcgaggaaatgagcgacgaggaactgtcccgcgaaatcggccgcatccgcgtgatcgcccgcagcacgccggttatcaagatgcgcgtggtgaacgctctgaaagcccagggcaatgtggtggcggtgaccggcgacggcatcaacgacgcgcccgccatcaagaacgcggacgtgggcatcgccatgggcatcgccggcaccgaggtgtccaaggaagccagcgatatcgtgatgctggacgattcctttgccaccattgtcaaggccgtgcactggggccgtggcatttacgagaatttccagcgattcatccagttccagctcaccgtgaacctgtcttcggtggtcgtggtactcgcctcgctgttcagtggtctggccgcgccgttcaccgcattgcagctgctgtgggtcaacatcatcatggatggcccgcccgcgctgacgctcggtatggagccgattcgcgacaatcttatggaccgcaggcccacccgccgtgacgccggcatcgtctcgcgcggcatgctggagcgcatcatcgtctccggcgcgttcatcgccgtggtgttcatggcgcaaagctggacgaacttcatgggcggcaccgccgaacagcagtcgaccattctgttcacgctgttcgtggtattccagctgttcaacgccttcaacagccgcgagctgggcaacgccagcctgttcgccaatctgctgcgcaataaggtgatgatcggcgtgttcgcgctgatgttcgcacttcaggtgctagtggtgcaattcggcggcgcgatgttccgcaccgtgccgctgccgatcgacatgtggctgaaaatcatcgcggtcggtttcggcgtggtggtgctgcaggaagttatcaagaccgtcaagcgcgcagccgccgccatccgcgcgcgccgcacggccaatgaaagcgattcccagcaaccgcaccagccaatcgctctggatctggtggactgataacacaccgataacggaaagagaccgacagattcctgtcggtctcttttcattcgcggtcggacagatgcgcggctagagttctttggctcggtagatgcggatggctataagcatggagccaaaatatgcgagcagacacaacacggcgagaacaagcgccgtatgccaccagatcgtcaggaaatcggtaatattcagcaaaagccattgccagtcaacaggcaatcgggacagcagcgcaatgacggcatacaagccaaccaggaccacgccagaggccaccatcatcttgcggaaggtgaaccggtatgcacaggccagcagcaccgacccaagaatgacagccaaagcgaagatgaaagcacctgctgccaaggtaccggtccaccccatatctgctatatcgccaaagacaatgaagacgccgccgcatatcaccacgtccaaagcccagagcaggccaaccaccaacagaaaaaggtaccgacctacaacttgtgcagtgcgtgaaacaggaatcagccctcgcatggcactgtgccctgcagattcctcggatgacgcaggccccaatgcactcatacatgccatcgccgatgccaaacctccgagtccgcccatcagaccactggcaacgtgttcatcgacgtgggtcggtatcgtcaccagcgataccacgatagacagcaccgggaaaaccagcagaaataccatattcgccacgctaaacagacccgtcccgacacaatcgaatcgacattgctttactacggatttccagctcatcgtcaccattcccttgaagcaaatatgcgagaggcaattacatacgagattccatatgccacaaccgtcgttgccaataccgcaataaccagccacaatcgttgcgcgatgatggcattcgcggcatgggccaatcctctggtcaccgaagcaggcgaaatagatagcagtatggatacagccaatacaacgacatagatcaccatcatcgtgacttgaagaccgcctagtttggtccacagataacccgtgggcacgataagcgcgatcatcagcgcggtgcagaaacctcccaacggcgccgcccacagattgcccgcgaatgaccaatccggattgaccagcacttgcaacccgtcaatcagcacgatcatcgctatcgacaatacggaaatcaccaatccaaccacatatcgcgcggccacctgactcttcctcgaagccggaataatgccacgaagtcgatatccgttctgtaagtcagcaaccgccatggttagcacccacatggcgcaggtgaataccgtcatgatgacacccatgcgatagccgaagccatcaccataagcttcaccttgaaagatgacggagaacaacggtgccaacaacaacgagaacacagtccgttcgccgacgcacaggtaggccatatcgacgcgcaatgcagtggtcaatgcatgttgccgagaccgcgacaccctcagtattgcctccatggccgctcacctcccgctcaagtcacgattggaatcatgggcattggtcagtcgaatgatgtcatcaatggaagccgattcaacgacaagccccgaaaccaccgacgcaacagcatcaagcctgtctgaccggaccagcgcatcgaatccggtggcatacgtatgtgagcccagcactacgtccgcaggcagttgtgccagttcgtctggaccgcccttaatcaggcggaacgattcctcaaactcgtctttcggaccggtgtagtagagacggccatcggtgatgtaggtaatgaagtcagcagcacgttcgaggtcggcagtgatatgggtgctgaacagtaccgaatgctcgccatcctcaatgtaggcatgcaggatatccatgagttcgtcgcgggcaagcacatcgagtccgctggtcggctcgtcgagaatcagcagcttggcatcatgactcaatgcgatggccagcatcagcttcatctgcatgccgcgggaaagatccttgatatgtttcttgccgttctgtgcgtcaccaaggccaaaagtatccagatacttgtgatagcatccaccgtcccatgatggatacagtggcgcaacgatacgttcaatgttcttgacttgccactgttcatgcatgtagctgaagtcgaacaccacgccgagttgttctttgacgggctcctcgttggcgatgttgtcgaggccgagcacgtgaatcgaaccggcgtcgcggtggatcatgttgaggatgagtttgatgagggtggatttgccggcgccgttcgggccgatcagtcccatgatgtagcccttgggcaggtcgaaggtcacgtcgtccagcgtgaagccggaatcatagtgtttggtgacgtcggtgacctgcaacgccatcgcgtcggattcggatatggcggtcatgtccatggtcctttcttgaggttattccttgcggtattcctcttcgagcatgcggtccaatgcgttcagcggaatgccggcggctttggcgccccggcttgcctcggccaggctttcacgaatccgggtttcgagctgacgttgcatcagttcgttgcccttgtccatcacgaaagtgcctttgccttgaatgttctgcaccacgccctcatcggccagttcgttgtacgccctggtgacggtgagtacggagatgcgcagctccttggcgagtttcctcaaggaaggcagggcctcgcccgccttcaactcgccactgagcaccgccgaatggatttgggttttgatttgctcgtagatgggttcaccggacacggatgagatgatcagtttcacctatgcccctttcgattgtggttgactagcaccccagctgtttagctgttatacaacacagtataactgttctgcttaactgtcaaggtgtgttacataacagttgaacagtgagcaaatacatcgtcaacttatagtgtcgaaacatgactcgtgcctacaatggcctcggaaaggggtacccatgcccaacaacgccccgccgacagccccgccagcgggggtgtaacttttttatcacagcacgcgcggagcgtcgtggaagtcgaagaggacaccgtcggccaggtggcagatctcgggccaatcggaggcggaggagtcgtcgtgcatggcccagaccttcatgccgaccgatttggccgacttcatgccgaccagcaggtcttcgaacaccgtgcagtcgaccggcgcggcgcctaggcgcttggcggcgagcagatagacgtcgggctggtccttgccgacgtcgttcgcgtcatcgacggagacgatatcgttgaacagatcgaacatgccgacgtggcgtagcgccggctcacgcagatgcgggggcagcgaggtggcgacacccagtttgacaccggaggctttcagatcgcgcagatagtcaagcgcgccgggtttggcttcgaccgtggtggaataggcgacgctggccatgtcgtcccattcctgcatgagctcttcgggcgtgtctgtaaggccgaagcgtgcgatggtgtattcggcgatctggcggaattgcatggcggagactttggtcatgtagtcgggcggcacttcgattccgcgcttgttcaggaagtcgatgtcgacttggtcccagactcccatggagtctaggagggtgccgtcgaggtcgaatatggcggccttggtcatttgctaatctccatcttcttcaaccaccctcagtcgcctgcggcgccagctcccgccagcgggagcgtaagtcgagaatcggataggagttctcgggcgtggtccagggaggcttcggattcgctgccggagagcatgcgggcgatttcgtggacgcgggtttcgccgttgacttcggcgatggtggtgaccacgcccaaatcgtcgtcatcggcatccggcggctccttggtgaccacgaactgcgcgtccgcccacgaggcgacctgcgccaagtgggtgacgacgatgacctgcgcgctgcgggccagccgtgccagacgtttgcccagttcgaccgcggccttgccacccacgccggcgtcaacctcgtcgaagatgaaggtctggtcggcaccgccgcgcgtgtcggcggccaccagctccaaggccagcatcagtcggctcagttcaccgcccgaagcgcttttgcccatcggcaactgcggcgacccctcgaacggcgtaaacaggaacgcgatatcgtcgcgaccatacgggccgagcggatcatcggccttgtctcgcggcgtgacgcgcacttccaaggaggcgcccagcatggcgagcgagccgagttcttcagtgacgcgcgcacccaagtcggcagcggcagccacgcgcgcggcgctcagcacgtcggcggcggcgagggccgcatcgtactgcgtctgccgttcggattcgagttcggcgaccttttccggcgaggcatccagatcctccagatcgaacgccgccttgtcccgccaagcgagcacgtcggccaaggtggggccccaccgacgggcgaggtcgccaagctcgtggatacggccgttgatctggtccagatcctccacgctgccttcgtcgcccagctcctggctcagggcgaacaccacgtcgcccaaatcggcattgatggattcaagccgatcggcctgctcggagaacgtgccgccgacgcgaatcgcgcgcaacgaggtcaccgcatgattgatgagttccacggccgaagcgccgtcggcggcgtccacatccacctgcgaggcatccagcgcgcccagcgccgaacccacgccttgggcgatgtcggccgcgttttcgatgcgttcgcggcgcgccttcagctcctcatcctcccccggctgcgggtcgattcggttgatgcggtcgatggattcgcgcaggtagtcggcctgttggcgggcagaggattcctgcgagcgcaggcgttccagccgctcatccatggcggccagcgcatcccacgccttgcggtaggcggccagttcggcttcgtctccggccacccggtccagaaactcgcgttgccgtgaggaggccgcgattttcagctgatcggtctggccatgaatggtaaccagttcgccggcgatggcccccagcaccgaacgcggtacggacttgccgccgagcacagcccgcgaacgtccggaagcgcgtacggtgcgggaaaggaacagttcgccgtcttcggggtcgacgcccgcgtcatgggccttggccacggccgcggcagcaccggtgaacccactgtcggcatcgccagaaccggcatcgttggtgtcgccggaatgttcagatgcgacggcatcatccgagagcgcgaaaatcgcctgggcccaagcctcgtccgccccggccgagacgcgcgaggattcggcggccccgccggagaccagtcggatcgcggagagcagcatggatttgccggcaccggtctcaccggtgatggcggtcatgcctgcggccggcgcaatggcggcttctcgaatcggccccagattgcggatatcgagttcttcgagcatcaggatcctgccttgccgtcacgttcgcccggcttgtcgggctcggtaccagcgacgccagcgtcaccggcaacggcaacgccagccgcatacgcggccgccgggaacgtgtgcccgtgatgcagcgactggctcgaggcctcgttgcgcgcgtgctcgcgccaaccgaccacgggcagatcgaacttggagaccagacggttggtgaacggcacgccggagagtcgggcgaggcgcaaggtatcgcgcgattcgcgcaccatgacgcgcgtaccctgcggcagggcgcgctgacggcgtccatcgcagcaaatccagccttcggacatggaatcgtccagaatatcgatggtgaaggtcgagccggagccgatgatcagcggcctggcgaacagggcgtgcgcggccaacggaatcaactgcagggccttgacgttcggccacatgaccggaccgcccgcggagaaggcgtaggcggtggaaccggtgggcgtggagacgatgacgccgtccgcgccgaacgagttcatctccacatcgtccacgcggatggacagttcgaccatcttgccccggtcggcgcgttccagtgtgatgtcgttcagcgcccaatcctcaatgggcttggtggcgccgggcagccagacgtccacatgggcgatcatgcgttcgtcgatcgaatagtcgtgggtggagacccggcggatcgcctcgtcgatctggaagctttcgaattcggccaagaagccgacatgccccatgttcacgccgagaatcggcacttgggtgcagtggacgagttcggcggcgcgcagtatcgtgccgtcgccgcccaggaccacgacgatttcggtgtcgtccgacacgcacggcggctgcacgccgaaatcgggggcctcggtgttgtcgatgatggcgacttcgaaaccggccactcgcagctggctcaccgcctcggccactacggttccggtctgcctgagcctggtatgcgtcaccaccaccgcgttgcgcttggccatggcatcctcctgtcgattcggtcgcactgctcattattctaaccgcagacaccgtcatcagtcgtacaggtgttcgaaaaatgctgcttcgtggcgcgtcgccggcaacgttccacagagtcgattatcgtaaggcttcggcatacaatggcgtacagccgcgcaatcaccgtacgcgtgccgtgcgcagcgcgatggcatgccgtatgaccgtacagcagtatcagttgaggagcttgaggacccatggccaatgacttcgacgaatcctccgccaatgaggaggcctcgaagggactgtcatggtggtattcagccgatgtactgagccgagacaaaagcgataaaaccgccaagcgcattcgacgtatcagcatcaccgaccgtctgctcaggcacccgggccgtctgtccatggtgtatttcggcgcactgatcatcatcgtcaccggtttgctgctgctgccgatctccacatcggacatcatcttcaccaatttcccgatcgcgttcttcaccgccgtctcggccctgtccacctgcggcattccggtggtgaacaccggcgaatactggtcgatgttcggccaggtcgtcgtcctgttctccatccagttcggcggtctgggagtcatgaccttcgcctcgatggtggctcttggcgtttcccgcagactcaaggtctcccagcgtatgctcaccgcgaacgagctgggcaccacgaagctttccgaggtcaaaggcgtgctcaccgtggtgctgggcacctccatcatcgccgaggtgctgaccttcgtgctgctgctgcccgacctgttccgcgtgaaccatggcaatatggggcgtaccttgtggcaggcgctgttctacgcggtgtcggcctataacaacaccggtttcacgccggatgccactggtctgcatgtgaaccgttggggcgtggggctgccgattctcatcagtgcattcatcggaacgctcggcttccccgtggtgctgaatctggtgcagtgcgcacgccggcggctcagcccgaaacgttggacattgcacaccaaactcactttggtgaccaccgctgtgctggtggccacctcactggcttggttcctgctggtcgagtggagcaataccggcctgttccccgcagatgaccccggcatgaagatgcgccgtgcgatgagcgccgccgtcatgccccgctccgccggtttcgatatttcctgggtgcccgaagtcacgaatgagaccaaggtgttcatgagcatactcatgttcatcggcgcaggttcctcatccaccgctggcggcatccgtgtcaccacgttcgcggtgattctcttgatttgccgcgccgcattcaccggccatcgcgatgtcaccgtgttccgccgccgtatcccccgccgtattcagatgaccgccgtgtccgtgaccacggcctgctttgcgttggttatggtcggtgcgatgatgctgatgttcaccaccggctgcgcgttcgtggacgccgtgttcgaagcctgctcggccttctcgttgggtggttattcggtgggcgtggcaagcgccggcaatccggccagcctgtttattctgtccgccgagatgattgtcggacgacttggcccgttgaccatcgcctactccatcagccgaccgatggctcccgaacctattcgttatccgcaggaaaacattatcgttggctgatcggccattcaatcggcgcccagcaatctgacatagagaggaccatcatcatggcagcaaaaccgagcggcaacaaaagcgtgctggtcatcggactgggccgtttcggcgggtccgtggccgccaccctcgaccagatgggtcaggatgtgctcgcagtggacaagaacccggagcttgtggcccgttggtccgcgcatctgcccaccattcaggccgatatgaccgatgtgctggccatcgagcagatcgacgcctcccagttcgacacggccgtcgtggccatcggcgacagcatcgaggcttcggtgatcatcaccggcaacctgctggacgccggcgtttccgacctgtgggccaagtccgtgtcccaggagcatgcgcgcattctgcagcgcatcggcgcccgccacatcatcaacgcggagaccgatgccggcaagcgcgtgggccatctggtggccggcaattatctggattacatcgaaatcgacgggccgtacaccgtcgtcaaggtccacacgcccctgtacgcggtaggccgcagcatcgaggacgtacaagtacatgacaagtacggcgtgaccgtggtgggcctcaaggccccaggcaaggagttccagtacggctccaaggaactggtcatgcatcgcaacgacgaactcatcctcatgggcaagcaggatcagatcgaccacttcatccaaggctaaccccctaactgcgctcgctataccccctatctgctcacatcgtgaccgatataaccccctcaacatggatgcgctcattattgtggcaataagccataaagctgtacgtccatattaataaggggagttttatcatcatgggcaagcatacgcagaattgcacgctgataggcaaaggagtctacggcaccataggagtggaccaacgttcccgtcttgccgatggcgcgcattttcacaccatgattgtgaccagcaccctcgaggcctcagttatagaaggggacaaactggtcatcaaaagtggcatcgtgcggtgtgatggtgatattcgcgtatccagcatcagcggcagcggcgacatcgaagtcggcggcgacattatttgcgatgagataacctttaccggcaaactacgatgcaacggcgatatcgtttgttccggaaatctgtccgtcaatggctccctaggcacccgtcatattagcggtcagacagtccgcttgaacggcgtgttgaagggtcatgacgtcaacagcagggctctggaagttcatccactccgcagtacgatgttttctcgttttgatatggatgggtatgaggatggcagcacggttcgccatatcacagccgtcacggttgaagccaaccatctgcaatgccggactttgacagcggactccgccatgctacgcaacggcagtgcggtggaaagcgccacgtgtgccaccgcactaggcgtcgaccgtacctccagcgtgctgctggtgaacggagactgccaacgcattcatctcaagacagcgtaaagcaggtattcctcattaccgtgggtgccgatgatgggactatcggcagtggccaccacgtcaagtccgtgctgttcagcacaggcgaccacgtcgtgtaatgcccgctcccgcaatgccggatcttcaacgatgccgtttttgccgagtcctgcccggccgacctcgaactgcggtttgaccagtaacacaatctgcgcaccgggagccgcgatgcgcgcgattaccggaatcacataggtcagggaaataaaggagacatcggagacgatcatcgccggccggtaaggcaggtcgtcggcctctacttcgcgaatgttgacgccgctcatttcgatgacgtgctcgtcattggcgatgcgcgggtcgagctggccgtgcccaacgtcgagcgctacgactttggccgctcccccgcgcaacagtacgtcggtgaagccaccggtggaggcaccgatatccagacattccaagccttccggcccggtaaggccattgccggcaaaggtttcgaacgcgcccaagagtttgtaagcgcctcgggagacgtagtcgtcgcccttatccacggcgagttcgctgtgcccggctttgaccatgaacgatggcttggtgatggtctcgccgtccacgcgcacatgcccggccttgatgagtcgctgcgctttggcccgcgattcgaccagtcccgaagccacgagcatcatgtcaagtcggtcaagtggagtcgcgggatcgatatgctgctcggtcatatatcttcctttcggcccaccatccaccaacggggtggctcggcatggagccaccatccagcacttcacgtcatcttccgctggcgggagaatgaatcacctctgctagctgcggctgttatcaagctcgtgttgtaaggattccagcacgttgcgataggtctcaagcttgcggtcgttgtcttgttcatcaatatccgcaagttcggggtatcgctcggtgaccggcgcgtgttcgctatccgtaggcataggactatgcctcgatggcgaacaccggtaccgtggcctcgctgagctgtgcgccttggtcggcggcttcccatgcggcgcatacggcggcacgcaggccgtccatactggtggggtcgctgacgtgtacctggccgttttcaaaccaagcgctagccttgcggcattcccaagtaccgctctcgtcgcggaccggctccggttgggcttcgccgagttcacgtagatcaagggcgatgaatgtgggcctcaggtgtgccggagccagcatcagttcggtcgggttggtgacaccggtcagcaccgccagcgaatcatagtcaccgcggttaccggcctcgatatcagtgtcgagtcggtcgccaatggcgatggacgcctccttgggcaccagatcgtggccttcggcggcgttcagttcgcgggcctcatcgtacatgtacgcttccggcttgccagcggaggcgaccggttcgacgccagtggccgtgatcacggcgcgaatcatcgatccgcaaccgggggcgatgcccagttcacgaggaatcgtcaggtcgcggttggtcacgaaatacgtggctccggcctcgaccgcgaacgcggcatcggccatcatctgccaagtcatatccggataccagccctgaataacggcctgcgggcggtcctgaggaccgtccacgatggtcaggccgttgcgggtgacctcatcgcgcaaatgctctgcgcccaatacctgtacgcgcgcgccggcgggcaacgccttggccaccacacgggcggccaccaccgaagaggtgatgacctgccacggctccacgtccaagccgaagcccttgagctggtcggctaccacgtgctggaagcgcgaggagttgttcgtggtgtattcgatggtcatgccggcggcttcggccgcacgaatggaatcggctgcgtattcgaccggattcttgccgcgatacaccacgccgtcgaggtccagcagcgcaagctgataggcctcggcgagcgggcgatcggtgcctttgaggaaacgggtcattacgccgctcactcctcggtttcggtttcggtttcgggttcggtggagtcggagtcggcggattcggcggaatcgtcagcctcggcgtcattggcggaatcggtctcggtctcgtcggcctcatcagactcggcatcaccgtcttcagcctcgtcatcctcatcgccgtattcctgctccggatccggggcgtactgcgcctcatccggatcgatgccgagcttttcgagcacgtcggagtcgtcggtgatgtcttcgagatcgtgatcgatcaccacgtcgtcgctgttttcgtcaatctcctcgtcggcatactggtcctcaagacggtccagcaggtcgttgagctgctcggcttccttgctgcggccgacctcttcaaggaagtactgctcggcctgcacggcacgcatgcggtactcacccggcagcccctgggaacggccgacggtgtgaaccacttcaatggccttgtcccacatctccaaatcgccaagggcaccggcgtacaccaggaacatctcgaccttgggagcgccatgcagctgcttgccctcatcggacagcgccagttccacggccttcttcggctctccgacgccacgctcgcagtcagcgatgaacggcaggtagtcgaggaagccgttcatacggtaggcggtgcggaactcacgcagggccagcttgtagtcgccctgacggtaggccacgaacgcaagcgtctcgcgggcgaagtcgatgcgggaggcctgacgggccacccacttggcgtgctccaaggcaagttcggggtcgctctcctccagcgcgaaagcggcgaggatgtgcagaccaatgttctccgcgtgctccttggacaggccgcgcagacgttcgcgctcatccttggacagcatcgaccattccatgcccttgggcatcttgggctcgtcgggacgacggtcggtgtacgggttctgcgaggggaagctcatcgtgccgtcggagttacggcgcgggcgcctcatgtattcagagcgcttctcctcacggtactggcgcttctcttcctgcgaaaactcgcggaattcgccgtcacgacggttgttgtcgcggcgatcgtcacggcggaagtcacgacgatcatcgcggcggtcgtccctgcggaagttgcggcggtcgccatcacggcgatcgtcgtcgcgacggaagttgcgacgctcaccatcgcggcggaaatcacgacgatcgttatccctgcggtcatcgcgacggaagtcacgacggtcattgtcacgacggaagtcacgacggtccccatcgcgacggtcgtccctacggaaatctcggcggtcgtcgttgcggcggaagctgcgacgctcaccatcgcggcggaaatcacgacgatcgttatcacggtgctggtagcgcggattctcgccgttctcgccttcgtgggaacggtagccgccttcgcggcgcggcttgaagccttcgccgtcacggcgcggaccattgccgcggtaaccgcccttgccgccgaagccggagcggccgcccttgtggaagccgccggacttgccgtacgacttgcggtagccgccgtggccctcgccatcaccgtcacggcgcggcgcgtagccctcgccatcctcacggcgacgcggcttgaaaccctcaccatcatgacgcggcttgaaaccgcccttgccgcgcggcttgaaacccttgccgccgcggttgcccggtcggcgatcgccataccccttatggccgccgccgtaagacttgccggaacgctcgttaccttctgccattacttgttttccttaattcgttgttgattaacggttttccacggcgccgagcgccttcttgccacgacggataagcgcgaagcggcctgccaggaagtcggcttcggccagcacctgatcctcatcctcgatacggttgttgttgagatacacgccaccggacttgatggcgcggcgtgcctcggaagcggacttgaacagtccggcagcctgggcggcgtcgattacgcgatcgccgggcttggagacggggaagacgtgctcgccgttctcgtcgaccaccttgaaaccgtcgagcacggattccagcgtttcctcgtcgatgtcttcgaggttgccaccgcggccgaacagcgcaccggaagcatcgatggcagcctgggtagcggcctcgccatgcacgaagctggtgacctcccaggcaagggtcttctgggcctcgcgcttgccggggttggtcttggattcctcgaccagtcgttcgatttcggccttgggcaggaaggtgaacgccttcagcaggctttccatctccacgtccgggcggttgatccagaactggtagaacttgtacgggctgagcatcgtggcgtcgagccagacggcgttgccctcggacttgccgaacttcttgccggaagcatcggtgataatcgggctggtgaacacgttgacgtccacaccgcgcaccttgtggatcaggtccaggccggaggtgaggttgccccactggtcggagccgccgagttccagcgtgcagtggtattcgtcaaacaggtggaggaagtcgttgccctgcagcacctggtagctgaactcggtgaaggagatgccttcctcagagttcaggcggcgggcgaccgtgtccttggcgagcatggtgcccagacggaagttcttgccgacgtcacgcaggaagtcgatgacggtcatcgaggcggtccaatcgtaattggacacgaaacgtacggcgttcgcgccttcggtgtccagaatgccgccgatctgattcttcaggcgatcggcccagccggccaccacgtccttcgggttaagcgtacgttcgccggactggcgcgggtcgccgatgagtccggtggcgccaccgaccaaagcgatcggatgatggcccgcaagctgcaggtgacgcatgttgatgagctgcacgaggttgccgatgtgcaacgatgcagcggtgggatcgaagccacaataataggtgatgggctcgccgttcagtgcttctgcgagtcgatcccggtccgtggactgggaaatcaacccgcgccattccagttcctcaagcagggtgttgaaacccgcttccttgaagtcggtgacgtgagccatagcttgtcgcttctccctatcgaattgtgaataagactgcccaattgggcacagtcaagtttcgcagaacatggcgacagtgccgaacaccagccgagccgcgcgattcagtaaaacgccttattctagcggcgcgggcccataagttcgcgcaaagagtcgatgatgtcctgacgatccggcacctggaacttcgggaaggacttgagcatacgcttctgctgtgcgttgatgacgccattgacggcccagcgcagacgctcaaccgtatcctgcgaaagctcacgcatcctgtcggataccgcactggagccccactgccacgtgccaccggcgcgtgccgccacatcctgtaccacctgagagacggaatcgagcacccgctcgaattcgagcatgcccgcaaccgtgatcgccaagtcgatgatggtgatcagggccagtaccgtgaccagcgtatgcagcatcggcagcggaatcatatccgtgacccgctcgacatatggctgcgaaccaagtaccacgcccacgccgccgaggccgaaaatcaacgcgcccagcaggcagacgcggccttggaggttgaagcggaagttcgagtaatcccaccagcgggcgtggaacagctgctccatgacccacgaggttgtgtattcgagtatcgtggcgcccaccatcgaaatcaggaagatgatgatcgggttatgtacgttgccgagaatggcgacgccgagtatcgcgccggtgccgtagatcgggcacagcgggccgttgaggaaccctcggttgaccaagcggtgctgttggcaggagacgagaatggactcgtacatccagccgacgaaactgtagaacagaaaccagaggaaataatgttcgagtgtgatgatcatcgacgggcttcgatctcggcgtaaggcttcgcggcgggcaacgcgcgcttgttgaaccggtcgaacgagaaggtctcggcggtggcggagcatttgtccgccaaggtgaccagatagccttcgatatagcgcggcggcaccggggtcatcgggaacatgtggttctcgatgctgttgcgttcgatatcgttgagcttgaagtccttcagggcattgaccagggcggcgtggccatgggtgaagccatgccactggtgttcgccgttatcccagtcgtgccagtcgtacaggaagtaatcgtgcaggagggccgcgcgaatcagggatttgaggtcgacgcggtaccacaggtgtgcgcggtcggccatccacacagccaggcaggcgacacgcacggaatgttcgaacgtggtgacattgccatgctggtagcagcagcgttcgatctgcatgtggcgatgctcgatgacctcacggccgtgcttggcgaccaggcgttgaatctgcgttcgggtgagcagatgtcccacgattttcggtccttcccgttttgggttggttcagtgcaatcccctgttgtgaattacgattacccggcgatattcaagaatccatcgagtaataccgtgaccgattgtagggcacaaatatgtccgtgcacactcatccaaaagaacgacaacgggaaccgttaatcgtggtgggtttcaagatagtcgagataaccttgaaaaccgccatcgaggcttgctacatcgtagccgcgatcggcaaggatttcagctacttcctcgctccaccatccttgagcacaatagactacgacagttcgatctgtgggcacggttttgagcacatgggccagagggtcgagtggtgcattgatggcaccttcgaccgggtgggcggcgaagtcggctggttccctcaagtcgagcagcgtgaccgtattcgggtcgagcttggcaaattccgccggcgtgatgcggcggtacgatgcttcactgctctcatcgtcatcgaccgcattatgcaaagcaataggcatgttcttcccctctcgttctgatcttggcacccctcaaggaggggcaccacatagctctaaatcgcgcaggccggctgaatatagttggccggatcaatagcagtaatggtcggctgctcaccgcacaccgggcaatccggcacatgctttggcagtgggacccgtcgaatattcatggtcagggcatccacagtgagcatgcgagccacgagcggctcccccacgccggcaatcagcttgacggcctcagtcgcctccagactgccgatcacgccgaccaccgcgcccagtacgccggcttccttgcaggtcggaatctcaccggcggcgggcaggtcgcggaagatgcagcggtagcaggggccttcgccgggaatgacggtcatcacctgaccggcgaatccgaccacgccggcatggatatacggcttgccggccagcacgcaggcgtcattgatgaggaattttgcggcgaagttgtcggtggcatcgatcaccagatcgtacggttcgatgaggccggcgatgttgctcgcgtcgacgagctcgtagtaggtatcaaccgtcacatccgggttgagcgcgcggatggctgtggccgcggattccactttgggcgctccgacacgtgcagtggtatggatgatttggcgttgcagattgctcatatccaccacatcgccgtccaccagtccgatatggccgacgccggccgccgccagatacagggcggccggagaaccaagaccgcccgctccgatgatgagcacgctggaggccagcaaccgcttttgccctttgacccccacacccttcaaaatcagatggcgcgcgtaccgctccacctgttcatcagtcaatgccatgttttctccatgtttccatctcccctcagtccgctacgcggccagctcccctcagagaggggagctaataaaagtgtcagtgcaaataccccgtagtcgggctggacggcacagcctgtccctcggtcactttgccaaggccagacaaatacgccgcacgaccagcatcgatggcgtgcttgaacgcctcagccatcagcgggatattgccagcagaggcaacggccgtgtacgccatcaccgcatccgcacccatctccatcgcatcgcaggcctggctcggacggccgataccagcgtcgatgatgaccggcacatgcgcgttggcgatgatgatttcgatgaagtcacgcatgcgcaggcccatattggagccgatcaacgaaccgagcggcataacggcagcggcaccggcctcctccagctgacgggccgcaatcgggtccgggaacatgtagggcatgaccacgaagccttccttggccagcatttcggtggctcggatggtttcggcgttgtccggcaagaggtacttggtctcgtgttcgatttcgaccttgacgaagtcggtgtggcacacttcgcgtgccagtcgggcgatacgcacggcttcctcggcgttgcgcgcaccggaggtgttgggcagcagcgtaatgccttcgggaatgtagtcgagcacgctgttctcggtggtctgcgcgcggcgcagtgccatggtgacgatttgcgtgcctgcatgttcgaccgtagccttgatgaggttcaggtcgtagcggccggagcccagaatgaatcgcgactggaactcgtgaccgcccaggttcagcggcttgtcttccaccgggagaatcggcgcggcggtgccgaccggattggtgacggcgggctgcggcggcagcggagtcgcctcaacagatgcttcagtaaccggattaatattgctcatagcttttcctttcatccaccctgtacaaactgcacaatttccatgacgcactggtcgtcgagcatggcgtcggcacgcttatcgcgcgggataatctcaccattgagttcgatggccacacgctcggcgcggaatccgtgcgcttcgagataatcggcgacgctgaccggcgtctcgagcgtgacctgctctccgttgacctgcataatatcctttcagatagtaaaaaagggtgcacgaaacgaaccgtaccttaagtggtgcgcccattcatgaacccaatcatgcgaccgttcgaccgctgtgatgtattggctccatcacgaccgtctcacggctgaattatgcaaacggaatgaaagctgtatcggagaacccggcaaatctgcgacaacgattccttacggcggcatgacccgcgtcaagttccccggtcgaagtctggcgacttcctctcagcctcacggctcccgttcgttacggtttctcagtgtatgccgttgcagtgacaacaacaaaatagagctccctcatcagagggagcttcattgggactagaacgtgccgggggctttgtaggcggagccatccgacgtggatgcggggaagagcttgagttcttcgacctcggccttggcgtcggcgatctgctcgcgcacgcgaccgtaagcggtgccgcccttgccgttgcgggagtcgaccgaaccgtggctggagagcacttcgcgtactcccggagccttgtcggccggcaggaacgcggcgaaggtctcgatgaagtcattgtcggtcagatcccacagttcctggccgcggccttcggcgagcttgacgcaggcaccagagagctcgtgcgcgtggcggaacggcaccccgttcttgacgagccattcggcgatgtcggtggccagcgcgaagccggtcggagcttcctcttccaggcggtcgccgtcgaagtgcatggtcctgaccatgccggtgaaggcgggcagcagcacttcgagcgtatcgacctggtcgaacacggcctccttgtcttcctgcagatcgcgagcgtaggcggtgggcaggcccttcagggtggccagcaggccggtcagatcgccgatgagtcggccggacttgccgcgggcgagctcggcgatatccgggttcttcttctgcggcatgatggaggagccggtggaatagccgtcgtcgagcttgacgaaggcgaactcctgggtgttccagatgatgatctcctcggacaggcgggagatgtccacgccggtcatggcggccacgaacgcgaattcggccacgagatcacgtgcggcggtgccatcgatggagttgtcggtcacgcgggagaagccgagctcacgcgccacggcctccgggtcgaggccgagcgtgttgccggccagtgcgccggagccgtacggggaggcgttgatgcgcttgtcccagtcgatcagtcgctgcacgtcgcgaatcagcggccaagcgtgggccatgagctggtgcgcgagcagcacgggctgggcgtgctgcatgtgggtgcggcccggcatcacggtgcggccggccttttcgctctgctcgatcagggcgttgacgaggtcaagcaggagtccggcgattacgcgggagtgacggcgcaaccacatgcgaatcaggcaggcgatctggtcgttgcgggaacggccggccctgagcttgccgccgagttcatcgccggcaatgtcaatcagaccgcgttcgagggcggtggcctcgtcctcatcgtcttcgatgggggcgaaggagccatcgtcaacgtggcgctggagcgtgtcgagcgcatcctccatgcgctgcagctcgtcggcggtcagaagtcccgcacggccgagagcacgggcgtgggcgcgggaaccggcgatgtcgtcgtcggccaagcgccagtcgaactgcgtggacttggacagtcgggccaattccggcgacggaccagacgtaaagcgaccaccccacagggccagatgttcgttgttctcagtcatgaaggctccttgaaaccatggattgcaaacaaatcagactgcttgtcagactatcagcgttgggctacataccggtggattcaagttgttcgtattccatggcggcaatgtcagggatactggtcacgtcgtattgatgaaaagaaccgcatcgtataccgcattacgggtaacgatgttcaaaacctggaaatagccgtctgccgaactcattacggagagcactgagcttcttccgtcatcggcaaaaaaacgaggggagcacgagcataatctttgctcgtactcccctcagtcatctgcggcgacagcgtcctgtaattacggacagcctgacggctgctgattgttggctcactgtcgttcgcacctcacctgcaaacagcccactgggctgtttgctttacggcgcggcccctcaacgaggggagccaaagtaaatgattactcgacggtgttctccgggacctcgatgccgttgccgaacttgacgtcgcgcgctgcggccacgcgggacggcaggccgtagatgtcgatgaagccgttggaggacttctggtcgaaggtatcgccggaatcataggtggcgagcttgtagtcgtacagcgaggagtcggaacgacggccggtcacgacggcgcgaccgccgtgcaggaccatgcgaatctcaccggacacgtacttctgggtgtcctcgatgaacgcgttgagcgactgagtcgccggggagaaccactgcgcatcgtagaccaactcgccccagcgcttgtcgatgtcgcgcttgatgcggtgctgttcgcgttcgaggcagcagttctcaagctcctgatgagcggtaatcagggccacggcacccggggcctcgtacagctcgcgggacttgatgccgaccaggcggtcctcgatgaggtcgatgcggccgacgccctgggctccggcgcggcggttcatctcttcgatggcctgcagcggagtgacgtcacgtccgtcgatcttgaccggcacgccttccttgaactcgatgacgacttcatcttcgaccggcgggaaggccgggtcgtcggtgtaggagtagcagtccttggtcgggccgttccacggatcctcaaggaagccggtctcaatggcgcggccccacacgttctggtcgatggagtacggggacttctcggtctgggtgatcggcagcttgtgctccttggcgaacgcaatctcgacgtcgcgggtcagggacaggtcgcgaatcgggctgatggccttcagcgtcgggtcgatggaggcaatggagacctcgaaacgaacctggtcgttacccttgccggtgcaaccgtgggagatggtgtcggcaccgaactggtgggcggcgcgcacgaggtgcttggagatcagcggacgggagatggcggagaccagcgggtagacgccttcgtacatggcgttggccttgagggccttcatgcaatattcgttggcgaactcgtcacgggcgtcgaccacgtaggattcgacggctccgcaggcaagggcgcgctgcttgatggtctcgaggctttcgccgccctggccgacgtcgagggacacggccacgacgtccttgccggtgcgctccttcaggtacgagatggcgacggaggtgtcaagaccgccggagtaggccagaacaatgcgcttgttatctgccattggttccctttcgttcaaggtctgaaaaacaaactgatgcaagtatatacagaggactgtatatttatgcacggcgtgttggttatttggaagcgagacttagtagccagtcggagcgggagacggcggtgtcgtcattggtgcaaatcaccatgacggtgtcgtctccggcgatggtgcccagcacgccttcgatcggctgcttgtcaatcaccgaggccacgtattgtgcggcaccggaaggcgtgtgcaccacaaccagatttccggcggcagccaccgaggtgaccagtccgttcagcacgcgggacatctgtgcctcaccgcgctcccctacatcctcaccttctgaagcaacgacgctgcgacccaccgtgtaggccaccgtgccgtccttcagccgggtcttcaccgcatgcatctcatcaagatcgcggctcagggtcgcctgagtcaccgcaataccctcgtcgataaggattttggacagctgtgattgcgaggtgatgatatgcgtggcgagcgcctgttctatggcactcagccgcgccgccctggtggcagggcgctgcagggacggaccggtttcactcatgcgagcaggctttcgtctccacgggccttgccggtcaaccaagtcagcaacgctttctgtgcgtgcagacggttctcggcctcgtcccacaccacggactgcgggccgtcgatcacttcagcggtgacttccttgccgcggtaggcgggcagacagtgctggaagagcgcatccggcttggccaatgccataagttcggtgttgacctggtaatcccagaacggcttggaacggatggcgtattcggcttcctcgcccatggagacccaggtgtcggtgaacacgcaatcggcgtccttcaccgcttccttggcatcggtggtgaccaggatggagccgccggtctcggccgcgatgcgcttggcgtcggccacgatgtccgggcggggcaggtagccgtaggggccggccacgcgcacgtccatgccggccacggcaccgccgagcaggtaggagttggccatgttgttggccgcgtcaccgaggtaggcgatggtctggttcttcaggttgtcgacgccgcctcggtgctcggcgatggtctggaagtcggcgagaatctggcagggatggaagtcatcggtcagggcgttgaccaccggatgggtggagtacttggccatttcttcgacgcggccctggccgaaggtgcgccacaccacaccgtaagccatgcggttgagcacacgagcggtatcggccacgggctcgccacggcccagctgggagccggacttgtcgatgaccagcgggtagccgccaagctcggcaacgccgatggagaagctggaacgggtgcgggtggagggcttgtcgaacagtacagcgacggcctgcggaccggcgaacggctgcttgtagaagcggtcgtggtggaacttgatggcaagttcgagcacctgcttctgttcctcatggttgaggtcgtcgtcacgcagcatgtggcgaagttctggggtcatgatgatctccttggatcggtgggtcggcagtgacagagagaaatcagtcgtcgggcaggtccgtaggcacatccttgaggatggcaagtgcctggtccacgtcttgtgcggttacaatcagcggcggtgcgaaacgcagcgcattgggagccaccgcgttgacgatgagcccgtgttcgaggcagtagttcatcaccgcgtgggagcagggatgcttgagctcgacggcgtccagcaaaccacggccgcgtacggaaacgaacagcggattaccggtggccataatgccatcgcgcagctgttcgccgcgagcttcggcgttggccaccagattctcgtcttcaatcacgtcaagagtggcgagtcccgcagccgcacccagcggattgccggcaaaggtggagccgtgggaaccaggagtgaacagagccgcaagtttctcgccgaaagcgatcatgccgcccatcgggaatccgcctgccacacccttggcgaaagtcaccatatccggcgtcacgccgccggacagatcgtcacgctggaatgcgaaccacttgccggtacgtccgataccggtctgtacttcatcgatgataagcagcgcgtggttgatatcgcacagttcgcgcacgaacttgacgtaatcggcgcccaacggctgcacgccggcttcgccttggataagttccagaatcacagcagccaccggacccttgccatagcgaccgagaccggtctgtgcaaaagcgtcgtgcagggcgaccttgtcgccggcgcgcacgaattcgatgttcggcaccagcggatcatacggcttgcggataccgggtttccacgtggcggacagcgcacccatcgtacggccatggaagccgtgagtcattgcgagaatgcgtgcgggcttgccgccgatggaaggcagggcaccaggcaaggtgcgtccatacagcttggcgagcttgagggcagcttcattgccttcagcaccggagttgccgaagtagactttggagccttcaggtgcaccagccagcttgaccagttttgatgccaattcaatttgcggctcggacgcaaaatagttgctgatatgagccaccttggcagcctgatcggcaaccgccttgacccacttggggtgggcatatccgagggaattgacggcgatgcctgccaggaaatcgaggtattcgttaccgtcaacatcccagatgtgggcaccttggccgtgatccatgacgcgcagcggcgtaccgaacacattcatgtggacctgagagtactctcccagccacttgctgtcttccgtacctagtttttcctcatgctcagtagccataagagctcctcatttccagtccttcatcaggcataaccatggtaccgatgcctgcggaggtgaatatctcgttcaaaatcgaatgcggcttgcgcccatcgatgatatgggcttggggcacgccaccgtcgatggccctgacacaggcctccatcttgggtcgcataccggattccaggtccggcagcatatcgcgcagggtttccacaccgatccggccaatcagagaattcttgtccggccaatcggcgtacagaccatccacatcggtcaagataacgagcttgtgtgcgcccacagcggcagccaaagcggcggcagcggaatcggcgttcacgttgagcacttcagtggcatcttcttcgttcggagccacggaagagacgaccgggatacgaccggcggccaccagatcctcgactgccgaagcatcgacggaaaccacgtcgccgaccaggccgatatcggtggacttgccatcgatgatgggcctgcgctgcatggccgagaacaggccgccgtcttcaccggacagacctacggccagcgggccgtgcgcgttgatcaggcctaccagttcgcgtgaaaccttgccggtcagaaccatgcgcaccacatccatggcctcgggggtggtgaccctcaggccgcccttgaattcggatttgatgccgagggccttgagcatgtgggaaatctgcgggccgccgccgtgcacgacaatcgggtgcagacccacctgacgcagaaagaccatgtcttcggcgaagcactgcttcagatggtcatcgaccatggcattgccgccgtatttgacgacgatacgctggccggcgaactcctccagccatggcagcgcttcaataagcacttctgccttctgatcggcgcgcaaatcggtgtgcacgtcgaaatggaacccaggtcccttcaattctgtagacaatttttctcttttctgcgacgccggcgacgctatcgctgccggctgctacaaacagcccactgggctgtttgtcagctttcgtagtcggcgttgatgtggacgtattcgtgggtgagatcgtcggtccagacggtggcctcggcgtccgagccggtgttcaggtcgatgtcaatgtggacttcgcgcggggtcatgtcgacctcgctacggtcgcggccggcaccgccgttctcgcagatgcgcacgccgttgacgtccacggtcaccttgttcgaatcgtaaggcgcgacttcaggtggcacagtgcccagggagctgacgatgcggccccagttcggatcgttgccggagatggcgcacttgagcaggttcgaggcggcgacggcacgaccacaggcaagtgccgcgtcttcgctggtggcaccggtgacggtgatacggatgtcgtgggaggcaccttcgccgtcgccgatgatctggcgggacagggatgcgcaggcctcacgcaccagcttgttgaattcgtccttgtccggttcgatgccagaggcaccggaggcgagcagcaggaccgtgtcgttggtggacatgcagccgtccacgtcgatgcggttgaacgaatgttcggcagccacagcgagtgcggcctgcatctgaccggcggagacaaccgcatcggtggtgatgacgcacaacatggtggccagctgcggggcaatcatgcccgagcccttgaccatgccgccgatcttccagccgttggagccggtcagttcgaccgtcttcggcttggtgtcggtggtcatgatggcgtgggaggcgtcggtgccggcttcggcggtggcggcaagagcctcatgggcactcttggcaccagccagcacgttgtccaacggcagcagttcaccgatgagaccggtggagcagacagccacatcattcggttcggcgccgatgagcccggcgaccgtttccgcggtggcgacggactgggcgtaaccggcctcgccggtgcaggcgttggcaccgccggagttcagaatcacggccttgacgtgaccgtcggcgacgaccttacggctccactgcaccggggcggcacagaaacggttcgaggtgaacacgcctgcagccgcgtcgagcgggccgttgttgaccacgagggccaagtccttcttgccttcgacggatgaaataccagccgccacgccggcggcggagaaaccttgtgcaaatgtaacgctcacggtgctactccgatcttggtcaggcccgcgtcttccggcaggcctagtgcgatgttcagtgattggaccgcttgtccggcggtaccacggttgaggttgtcgatggcggcaaaagcgtagatgcggccggccttgcggtcggtgacgacctgcaggtgggctgcgttggatccgatgatgttgccggtggcgggcagcgtgccctcgggcagcagcaccatgaagtcctgaccttcataggccttggaccatacggcgcgaatctcctcatcgctcagtgtcttggccttgtccgtcatgcgggcggacacggtggcgaggatacctcgggacatgggggcgagaatcggtgtgaagccgagcgtgaattcgctggcttcggccgcgctcttgccggccgcgtgggcgaagttctgcaggatttcgggaatgtggcggtgcttgccgcccaccgaatacggcagggcggattgcagggcctcggcggcaagcaggttggtgcgcttgagattcttgccggcacccgagtatccgacgaccagatcggccacgatatcctgcgattcaaccagtccttcggcgatgccgggctggagggccagcgtggtggcggtgacgttgcagccaggacctgcgatgcgcttggtgccaggaagcgccgcacgctggcgggtgtaggagccgtccgcagctttgccggtgatgagctcgggcatgccgtaggtccaatgctcatagaaatcaccgccgtagaactcatcccaagcggcctgttcttcgaggcgatggtcggcgcccaaatccacaaccacggcattcggatcgagctgcgaggcgagcttgcccgaagcaccgtgcggcagtgcgaggatgataacgtcatgcccgttcagcacttcgggcgtggtatcttcaacgaccagattggccagttggggaatatgcggcatgtgcttggccatcgactcccccactgaggaatggcctgccacgcaggtgatgtcgaagtcggggtgcgcggccagaatgcgcagcgcttcaccgccggcatagcccgtggcaccggccacggccactgtatatttcgccatactcatctcttttcactgatgtgtcttcggatgagtatacgcgattatgcagactattgcatatttatgcagtgggtgtgttggtatgtgaacgctacttatgcggagatggagtcggaggaggagccggtgccgccggtcagttgctggagggcttcctggtaaaggctcatggcgtcatagccattgaaggccatccagatgacggcgatggtgtacagcacgttgattaccacggcggccacggccaaaccgaagcccttcatatggaaagtgcgcgtgcgccacattgccaccgcgcccatcagtgccgagagcactggcaccgggaagaacagggcgaggataaaggagatgatcgcatacgaatcccagtgcccgtagagtgggttctggtttggatcgttcaggtcgatgccgtggtaataatgcggctggtgaggctgaccgttcggctgttgaccatacggctggccctgcatgcccgggtacccgcccggatatgcgcccggaccggactgttggccgccttgagcgtacggccagccgcccgcctgctgattgccgggccacgccggctgctgaccatacggctggccagcctgctgagattgtgccgcgccaccgttatcgccagcggctgcggcggaatccttcttagtatccggctcgggagcgccataaatatacgggttgtaattcggcccgtattggccagacatagcaccatattcaggctgctggtactgcccgtatttcggcttgtcctgctccgcttggctcatggcgctcctcgattcggatgattggttgggtcaggcgcgcagctgggcaccgatttcggcggcctcagccacgatggccttgcggatggcgtcgctgtcttcggcggacagcgtcttgctcggcgaacggaacaccaccgcataggccagggacttcttgccctcgcccacctgttcgccggtgaacacgtcgaacagttcgatggattcgaggttcgcgccgacggccttgcgaatcacgttctcaagctggcctgcggtcacggtctcgtccacggtgaaggccaaatcctgcttgaccggcgggaacgtggagatcggcttggcctggacgggcttgccggtcagcgtggcgaacagcgcggtgaggttcagctcgaaggccgcggaatgggccgggaagccgagcgcctcgttgacgcgcgggtgcagttcaccaacccagccggtgaagacgtcgcccaccatgacgcgggcggcgcggccggggtgccattggactggcacatcgtcggcggcgggctggtcgagttcgattgcggcaccgatacggccggcgatgcggcgcacggcctcgacggcgtcggaccagtcgaccgggcgcttgccgcccatccagccgtcgtcctcggccagaccggtcaggatgccggccacatggtcgggctgttcgggcagaccggcgtcaagcgcggcgagctgttcgtcggtggggcgcacgccgccgggcagtgccgggatggcgggcgcgttcggatcccacaggtagacgtggccgagctcatacagggacacgttttcgatgccgcggcggatgttgcgctgcacggtggtggccagggtcggcagaatctcgcgacgcaggtacggacggtcgccgtagagcgggttggcgatctcgacgctgaccttcttggtggcttccgggtcgaagccgaaggccttgtaatcgtcgtcgcccacgaacgggtagctcagcgattcggccatgccgaactcggcgagctcgtccgccacgcgacggcgacgctgctggtccggggtcaggcccaccagaccctcgaccggtgccggcggcacggtgatcggaatctggtcgtagccgaccagtcgggcgatttcctcgaccaggtcgcacggctcgttcaagtccggacgccagctcggcgcggttacggcgaactcgccgttgccgccgccggccaccgtgcagccaatgtcggtcaggatgtcggagatgcggttgatgtccacgtcgaggccggccacgcgggccacttcggaggccttgaagtggatgaccttggcgcgcggcgtgttgttcacgtcgttcgggtgttcgctgggctcgccgttgccgtacttggccatgagctcggcggccatctgggtggcggcgggctgcagcgcggtgtcgacgccacgttcgaagcggcgggaggcctcggatggaatcttgtggcgacgggccgaacgggcgatggtcacctgatcgaagtgcgctgcctccagaagaatgttcttggtgtcggcggtcacttcgccatacaggccgcccatcacaccggcaaggccgaggatgcgcgagccgcgttcgccgttcggcgaatcggtgataagcagatcttcgacgctcaggtcatgttccttgccgtccagggtggtgagtttctcaccctcgttggcgcggcgcacgacaatcgggccttcgagcttgtcgaggtcgtaggcgtgcatcggctggccgaggtcaagcatcacgtagttggtcacgtccacggccaaggagatggagcgcatgccggcgcgaatcaggcggcggcgcatccagttgggcgtgtgggcgttgggattgaagtccttgacgatacgcgcgtagtagcggtcgcaaccgggcacgccgtgaatcggattgttatcgtcgatttcaacatcgatgtccaccggggtgccgggctgatagtcagcaggttccggggccttctcgttcagtgccacggccggatcggtgtaggcggcaccggtggagtggtggtattcgcgggccacgccacggtaggacagcgtgtagccacggtccggggtgatgttgatctcaagcagaggctggtcgaggtgcagcaggtgcatggcgtcctgaccaggcttcagagcctcatattcagcctcggagaagccgtactgacgcagcagaatgatgccattgtggttgtcgcccagaccgagctcacgttcggaggcacacatgccgttggagatgtggccgtaggtcttgcgcggctcgatcttgaagtcgccgggcagcacggcaccgggcagggtgacgacgaccttttcgccggccttcatgttgggcgcgccgcagatgatgccgcgcggcaccttgttgccgtcttcgtcggtctcgttccattcgtcgccgcagtccacgtggcaccagttgatggtcttgccgttcttctgcggttcgggggtggcgtcgaccacgtagccgaccacaatcgggccggtcacctgagaggagtgaatctcctcttcctcaagacccaccttgacaaggtccttggcgagctgttcgtaggtcaggccttcgggaacctcgacatggtccttgagccaatcgatatcgatcataggcatggctgaatcactcccccatcacaaactgttcggcgaaacgcacgtcaccttcgaccaggtcgtgcatgtcgttgatgtcgctgcgcagcaggagcgtgcgctccatgccgacgccgaaggcgaaaccggtgtagacgtccgggtcgatgccggcggacttcagcacgttcgggttcaccatgccgcagccgccccactcgagccagccggggccgcccttcttgtcggggaaccacaggtcgagttcggcgctcggctcagtgaacgggaagtagctcgggcgcaggcgcgtcttggcttcagggccgaacatggcgacggcgagcttgtccagcacgcccttcaggtcggccatggtcaggtgcttgtcgacggcgagggcttcgcactggtggaacaccggagtatgggtggcgtccagctcatcggtgcggaacacgcggcccggggacgcgatgtacagcggcactccacgggtcaggagggcacggacctgatcggaggaggtctgcgtacgcaccaccatgttggagccgacgaaaccggcggcgtccttggcttgattgcccttgacgtagaaggtgtcctgcatctggcgggccggatggtccgggccgaaattcagggagtcgaagttgtaccattcggcttcgatttccgggccggaggagatctgccagcccatggagatgaagaagtcctcgacgtcctccatcagcttaggcagcgggtgacgggcgcccagaggcttacggctcaccggcagcgtcatatccacggtttcggcggcaagcgcggccttctcggcggcttccttgagctcgacctccttgggaccataggcgcggccgaagtcggcgcgcagcttgcccatgagcttgccggcttccttcttctggtcggcgggcagggagccaatggccttgctggccttggtcatcgccgaatcggcacctgcgtacgttgtcttgatggccttgagctcctccaggttggaggcgttctggattttctcgatgccctcggcaacctcagcggtcacctggtcggcgtcgaacaccatttgttctgccacgagaaccctttcgtctgatgttttctcagcgtttcacagcgtttttaccggtttcacattctttcaacatgacccgacatagacagcgacatcagcatcaccgcggccgaggtgccgaggttcagcgattcggccttgccataaagcgggatggagacgatgcggccgcagcgcgtgaggatgtccggttccaagccacgcgcctcattgccgaacagcacggctttcggagcctcgaccgccgccttgtccgccagtactgcgggcaggctttccggcttgcgttcttcggtgccgtatacgtcggcggcccagacgtccatattatggtcgcctgtccaggtgaagaattcgtcggtgctcatggcgagtaccggcagatggaacagggagcctgcggtggagcggatgaccttggggttcagcacgtccacgcagtcgtccacgaagattacggcgtcgcagccggccgcatcggccgcacggatcacggtgccggcgttgcccgggtcgcgcacctgccagaaggcggcaatctgcggggcccgaccgttcttgccaagttcgacgtcatcggctccggcgtgcatggactcggcattgccgacggccgcgatgccttgggtgtccggactgatgcggcgcatcacgtcgccggtgcagtagtgcacataaatcgtggcatcctgcgaggtttcgacgatcttctccaacgtggaggagatgatacgcggatgttccagcgcctgcgaaacctctacatacaggtcctgcaccacgtccggccgccaagtgacggcctcgcgcacggattgcgggccttcgataagaaaacggcccgaacgttcgcggcctttggcgcgggtcagatcggcgatgcggcgcacgcggtcggatttcggattatcaagaatctgggcgttgatgggcatagccactaccctactgccgggtcattacgtcagtcgcgagactgagggtggtcgaggctggaaccaccccagtcggctacgccgacagcccccgccagcgggggcatcataaggcgttcagacaccttgaaaggcactgtgctaatctgtcgcctttcagacaccctgaaaggcactgtgccagcctgtcgcctttcagaccccctgaaaggcactgtgccagcctgccgcctttcagaccccctgaaaggcgaagtgccaattcccggtgccgacggctacgcctatggaggccagcgggacggccagacagatgacgtagaagatccagtcgataggcttcagacgcgagatgcgggcttgggaacgtggggcgccggagccgaagccgcgcgcttccatggcggtggcaagtttggtggcacgccggatggagagcaccagcagtccgaacgcttgggagagagcacgggcgatggcgttaccgtcaccaaggccgcgcgaacgctgggacaagccgagtgcgcgccaatcttcctgcagcagcgtaaacatgcgcaatccggccaatccgccgtatacgaatcgcggtgagaagtgcagaatctcaaccagaccgtccgccaaatcagtgggatcgaggcccaaggccagaatcacgccgggtacggcaatggccgccaccctgatagccgtggcgatggccagattgatggacccctcgctgatcacaatccagccaccctgccacaggatctcgcccgaggtgcggccgtagaggaacacggagataaaactgccggcggcggcgatccataccggccaggtcttacggcatacggtccacggagccacgccaccaatccacagcagcacgaattcgatgccgagcgccgtggatgcggataccacatccagactgatgaacatcggaacgcacagcagcaacgcaccgatgatgcgactgaccgcgttgatgcgcgcgatgaaccatgagggcgatgaggctttgaccggctccacgcgcgtttcctgcgggctgacggttaccacgtcactcatgccttcgcctcctcgaacatcacacgtcgtgcgcccagcgcatccaccagcgcctcatcgtgcgtcaccatgatcacgcacgagccttggtcgcggatggtggcaatcagcttgaccatttcattccacgtactgaaatcctgtccgaatgtcggttcgtccatcaccaacactttgggtgcggcggccagcatggaagccacggacagtcgccgcttctccccgccagacaaggtgtacgggttggctttggcgaagcgcgtgagattcatctgctcaagcatgcggtcggcggtctgataagcctcgtcttggctctgccccatcgacttggggccgatggatacctcgtcacgcacaaagttggcagcgaactggtgttcgggctcctggaacaccatgccgatacggcccagcagttccttgcttttccagtcgatcggctcacgcccggcatgcgcgggcttgaggttgtcggcgatgagcaccttgccggcgataggcttgagtagcccggccaaggtcaaggccaaggtcgatttgcccgcgccgttcggacccatcagagccgttacttcgccgggataaaaatccagattgataccaacgccaagagcggccccacggccaaagcttaagttctcggtgctgagcaccggcgcatcgtgcgcagactcctgcttcggtgagtaatcgggaatcgcacggcccggcacccacgcgccaccggcggccaacacgtcgcccatctcggcgaacacctcgtccggcttgccgtcggcaatgaccgcacccgtgggcgaacttgcatcgggtcggccgagcacaatcacgcgatcgaccagatcgagccatacatcgatatgatgttcgaccacaaccatggtctgtccggtggcctcgatgacctttttgaccgcgtcatgcacttcgaccacgccttcgggatcgaggttggcggtcggttcgtccaacaacagcagaccgggcttcatagccagcacgccggccaacgcgagacgttgacgctgaccgccggacagatggcgggtggaccgatccagttcgagtccgccgagtcccaccatatccaatgattcgcgcactcgctgccaaatctcctcgcgcggcacgttgaggttttcgcagccgaaggccgcgtcatcgcccagtcgttcaagaatgatctgcgagtccgggtcctgaagcaccagtcccacgcgacctcgcacctcgcgcgcatcgacgccatcgatggtgagcgagccctcctgctcgccttcctcatcgccgccaagtacgcctgcgagaccggccatcatcgtgcttttgcccgcgcccgaagcaccgagcagcaacacacgttcacctggccggatggtgaaatcgacggcacgcaacgcgaagtccttacgcgtggcgtgccgccatccccagccgctggcctctaccgcagccggattaatctgcatcagacgcgcgccttgctgcggccggattcaaaacgctccagagcaccggtgacggcgagcgcacgagacaagtaccagaccaccacgccggcgatcacgacgccggagatgatggagcccaccagataccaagtgacgcgcaggccgttccagcccgggttggtggcccagtagtaggcccagcagcccacgccggcgagcgcaccggacaggatggtggtgccgatgttccacttcttccaagcgaagacggcgaaggcaatttcggcacccagaccctggatgatgccgacgatcagcgagccgccgacgccccactggttgcccagcgtaagttcaaggaaggcggcgagggtttcggcaaacagtgcggcaccgggcttgcgcacaatgattgcagcgagcgggccggcgaacagccagaatccgttgagcagaccctcgaaaccgggggtcacgccttcaaacagggccagcggggcggagcagacaatgtcccagccccagaaaatgacgccggatgcgacggcgatgattgcggcgacgacgatatcgacgacgcgccacttgtaattggctttggccacagcttcagtcatgaatgtgcctttcttctgctcgcacgcaggccgaacatacatggatatatgtacgcacataatgcacatgttcgtgtccacgcgcgggttggttcaggcacgggtgggtaagagcgacatttccgtgcgccggcattatccggtcacgttccatcggtcgagactatgagtctcctctcagccgcccaacggcagctcccgtgtcaactcccgactataaagcaagccgacgtcaaaggcaatagccacatctgtgacctacctgacggcggctcactaccattaccgatgcggttcggctacttgccgagcttgtccagcagcaaagcctcggtgatcacgttgttcttgaggccgggcagggagatggactcattggggctgtgggcgttggccttcgggtcttcgggaccggtgaccagcacctgagcgttggggaaaatgcgctgcagttcggggatgaacggaatggagccgccttcgcccttgttgatgggctcaacgccgaaggcctcggtcatggcttccagcgcgtccttggtggccacggcggtcggatccatggcccagcccatgccgttttcgccgcgttcgacagtgaccttggcaccgaacggcgcgtgggattcgaggaatgcagccagtgcttcctgcgcttcttcagggtgctgggtgggcgcggtgcgcagcgacagacggaagcgggtctccggggcgatcacgttgaaggatccctcgaccgggtgggcgtcgaagccgatcacggtcacggacggcttagtccacaggcgtgaggccagcgagccggtgccggcgaactcgtaaccggccaccacgccagaatcctcgcgcacggtggtttcgtcaaggtcgtgctgcaaaccgccgatcggctcttccgcggtcacgccgggtacggccagatcgccgttctcgtcatacatggaagcgatgagcatggcggccaacgtattggagtcgagaatcgggccgccgtactggccggagtgcaccggatgctcaaggccctgcacggtcacgtccacacaggtgttgccgcgcagcgaggtggtcaaagaaggaatgtccgccgaccagttgccggaatcggccacgataatcacgtcagcggcgaattcgtcgcggtgagcctcgatgaagggaatgaagcttggcgagcccatctcctcttcgccttcgatgaacactttgatattgacgttgaggtcgtcgcccagggccttcagtgcaccggagtggatggcgatgccgccgccgtcatcggcggagccacggccgtagaggcggccgtcgatttcggtggccacgaacgggtcggtgttccactcggccgggtccggaacaggctgcacgtcgtgatgggcatagagcagcacggtgggggcgtccggagaaacgatatgcgagccgatgacctcccatgcgcccggagtgccgtcggcattggaagcctgaaccaccttggtatccacacccacgaggcgcagttcgtctgccacgaattcagcggagcgcttcatatgttcggcggtgatgcccttggcggagatcgactgcagcgcgaccttttcggccagcaccttgactatgcggttccaatcggtttcgacgcgcgaacgaatctcgtcagcggtgagcgttgtcatgatggtcctcctttatatatgtgtgtgagcggcgtcattgcaatggctgcgccagtgtacaagtgtctgaacgtcaccgtaacctcaaagcatgacatggaatccgtttaagaaaaaagaagaggcccaagctcctgttgagcaggccccgaagaaggctgccaatccttctgagaaaaaaggccgtcctaccccgaagatgaagcaggctcaggccgccggtatccgtccgctggttccggtggaccgcaaggccagcgccaaggccgccaaagcccgtctgcgtgagaaggagaacgccgagtacgaggcgatgcagaagggcgatatcaaccacatgcccaaggcggaacgcctgccttggcgtatctacatccgtgattatgtggatgcccgtttcaaccttggcgaatggttcatcccggtggccttcgcgattctgatcgtctccatgttcgtcacttctttgatgcagaaccagtgggcttccatcatcatgatggcgcttatgtacggttacctgattgccgtgatcatcgacgtatggctgatgtggcgcaagctcaaggccaagctcatcgccaagtacggcgaacagtccgtgtccaagggctcccgctccttctcctacgcttggagccgttcgattcagatgcgtcgttggaggcttcccaagccgcgttacccgaagcgcggtcactggccggcagactgatgtccatatatactctggctcccctcgttgaggggctgagccgtaaagaaaacagtccagtggactgtttttaggcgaagtggcggcgatagccgcatatggctccctagcgtgggagccatacttatatgtatcaaggaggcaatcatgagcgaacagtttgatctggtcatcatcggggccggccccggcggctattccacggccttgcgcgccgccgaactcggcatgaaagtggcactcgtcgagcgtgacgccaccgtaggcggcacatgtctcaaccgtggctgcatcccctccaaggcgctcatcaccgccacccacaccatcgacaccgtgcaccgtgcggccgagctcggcgtcaacgcctcggtgaatggcatcgacttcggcacgctgcgcgactatcgcctgcgcgtggtcaagacgatggtgggaggactggccggactgcttgcccatcgcggcatcaccgtgttccgagccaatgccgcgttccatgcggatgagaccgctccagcaacttccaaccacatcgtccacctcgtcccttcccccgaccaaagcgacatcctcacctatcacaaggccgatgtccccgagcccagcggccccacgatggacctcacggccacgaacatcgtcatcgccaccggtgccaagccacgcccattgcccggcaacccgttcgccggcgccctcatcgactccacacaggcgctggaagtcaacgaatttccctcgtcggcggtgattatcggcgccggggccatcgcccttgaattcgcctcgatgtggaacgccgccggttcgaaggtgaccttgctgattcgcaaggaccgtgtgctctcagcctgggaccggagagccggcaccacgctgacccgtgagctcaaacgtcatggcgtgaacatcatcacccgcgccagcgtcacccatgtggacaccggcgcgaaccttggtgccaccgtgcactacacgcgcgaaggccaggacggcgaacaaagcgtctggggcgaaatcgcccttgtcgccatcgggcgtgacccgatcaccgacccagcatggggcgtgacgattgacgaccacggacatgtcgccacggatgcgtacggtcgcaccgacaaaccgggcgtatgggcggtgggcgatgtgacggccggtcacgcgctggcgcatcgtgcttttgagcaaggcatcgtcatcgcggagaccatcgccggactcaatcccaagccggtggacgaagccaccgtgccgcaaatcgtgttctccttccccgaagcggcgtcggtcgggctcaccgtcgaacaggcgcaggcgagagaggatctcattgaaatcaaggagaccaactatccgatgctggcgaacgcgcgcatgctgatgagcggcacggccggttcactgaccatcgtctccggctgcgacgcggccaacccggacaccccgcgcgtgctcggcgtgcacatggtctcccagatggcctccgacatcatcgccgaagccgaacagctggtcggcaaccatgtgccgctcgccgacgcagcccgcctcgttcacccgcatcccacgttcagtgaaacgctcggcgaggcgctgctcaaggccgacggacggccgttacacacacgctgagaccaaccagcacaaacaagttcggaccagcgcacctgataagatgctgtctagtgtgtttcgtcccaacaaaggaagaagtgatggcggaaaaggacgcgaagccgaagaagcagagcacaatcaagcagatcatccagatctacaagtacacggctaaggaagacaaggccctgccgtggcttgaggccggtgctttcctgctgcctgtagtcgtgatgatcatcatcggtctgattgccaagtggacctggctgacctggatcttcaccatgatcaccgccatcatgctcggcatgctactggccaccatgatgctcacccgccgcgcggatgcagtcggctacaagcagattgacggcaagcctggtgccgccatcggcgtgctgagcaacatgcagaaagccggctttaacttcccgcaggaaccggtgtggatcgacccgaagaccaaggatgccatctggcgcggcacttcgatgaacggcatctacctgatcggcgaaggcgaatacggtcgcatcatgaaggcgatggatcgtcaggaacacgatatcaagggcgtcaccgccggctcctccattccggtgtaccgcatctccgtgggccacggccccaagcaggtgccactggacaagctgcgtagcacggtgaccaagtccaagagctatgagcccacgaaccacaagaacgcactgatcgccaagattcatccgcgtcgtcgcttcctgctgaccaaggccgagatggaaacgctgaacgatcgtctgcgcacgctgcaggccaagaagggttatgccatccccaagggcatggacccgaaccacccgcagaagatctcccgccgcgcgatgcgcggtcgctgatcggcagcacaccaccaaatcgcacagaagccccggaatccgttcaatcggttccggggcttcgtcatatgtctcataatcgcgtccacatacatccacctacgtcacctgtcaatatccactgtccacgttgcggacatctctacctactcccccgatagcctccgtttccattctgtaatgatgtttcgttgaaataacgcgcctgcgcgattgtcgaccacagtcacgaaacattctcgtaacccaagtttcgagccggcgaaacgcgctattttacgatatataccgttatatctcatacgaaaggagcggtcccgtgaccgaactcaagtccaaggaagacgtcgaggcccttatcaacaaggaaggcatcgagtatgtctccgtccgtttcaccgatcttatcggcgttcagcagcacttcaccgtgccggctagcgaattcctgaaggacgctttcaccgacggcatgccgttcgatggttcctccgttcagggcttccaggccatcaacgagtccgacatgaagctggtcccggacgttgagacctctttcgttgacccgttccgcaagcacaagacccttgacgtggccttctccatcgtcgacccgctgaccgacgagccgtactcccgcgacccgcgtcaggtcgccggcaaggccgaggcctacctgaagtccaccggcattgccgacaccgcatccttcgctcctgaggccgagttcttcatcttcgacaaggtgcgtttcgagaactccatgcagcgctccttctacgaggtcgactccatcgaagctccgtggaactccggcgttgacgttgaggaagacggcaccccgaacatcggtttcaagaatcgcgtcaagaagggctacttcccggttccgccgattgaccacacccaggatctgcgcgacgatatggtcgccaacctgcagaaggtcggcctgatcctcgagcgttcccaccacgaggtcgccggcgctggccagcaggagatcaactaccgcttcaacaccctgcagcacgcaggcgatgacctgatgaagtacaagtacgtcgtccacgagaccgccgctctggccggcaaggctgcgaccttcatgccgaagccgatcgccgacgacaacggcactggtatgcactgccaccagtccctgtggaaggacggcaagccgctgttctacgacgagaagggctacgctggtctgtccgatctggctcgctggtacatcggcggtctgatcaagcactcctcctccgtgctggccttcaccaacccgtccctgaactcctaccaccgtctggtcccgggcttcgaggctccggtcaacctggtgtactccgctcgtaaccgttctgccgccatccgtattccgctggccggcacctccccggccgccaagcgcatcgagttccgcgctccggatccgtcctgcaacccgttcctggccttctccgctcagctgatggctggcctggacggcatcctgaaccacatcgagcctccggagccggtcgacaaggatctctacgagctgccgccggaagagcacgctggcatcaagcaggtgccaagctccctggccgaggctatggacgccctggaagaggaccacgacttcctcaccgccggcgacgtgttcaccgacgacctgatcgagacctggattggcctcaagcgcgacgagatcgaccaggctcgcctggccccgaccccgctcgagtacgagctctacttccacatctgagtttgagagcttagccacgttggaattcccattgctcttccctcgtgggagtctaatgggagtcattcagcgtaactagaaagaacctcgtgaaattcgtttcacgaggttcttttttgtatgttgcgttgtgtgttatgcgatgtgtgttgctcctggaatattccaggggcgggccgctacttagtctcccaacgctccttgagtacataggcggcggctttgggctgacggtcgcgagtgaagacgtccttcttgttgccgtcgacgcgcatgataccttcaccggtttggaagtcgcagaggttccatacctgctcgcccaccactgcctcgaacatgtcgaacacttcgtgctgcatggtgaggtactcgcattggtactcttcactccattgcatgctcggcagcttgtgcacaccggcatcggtgtccgcaccgtattcggtgaacagaaacggcttgttgggttcggtgttcatccattggttcatctcgttgatgaaggccttcttggctccgatgagctgatacccatcttgcacataccagccgtaataccggttcaggcagatgacatccgcgaactgatggcacttgtctttgcctccggcggccatcagcagattggtgtaggtcagcgggcgatgctgcggatcgagcgtgcgcgcgtaatcgaatatctccttgaaatacggcacggccgcctcggattggagtcgttggcggcgtcgatgaaattccaagcgccggaggccccggcattcttttcgtcgaaggggacaattcagaacacaactgccgacacaatcgtcagggaggccagcgagaacagcgtgcttacgagcacgaagccgaccgcatactcgggcatgttgttcttgcgaccggtgaacatggcgatggtggtcatggtcggcagtccggcgatgaccgtgatcatcagcaccatgtcatgggtgatcggcagttgcggcaatgcgccggtcagcgcggtcagtagcgcgtagaaggcgagcgggaatgcgatcatcttggcgactaggccagcatagagttcgtagcgtttgaggacgccccaccacttggtcagcgcgaacaggccgcccaagtagattagcgacatcggcgtggccatattgccgatggtgtgcagcggcttcaggatgatgtccggcaccttgacgccgagcagaatcagaatcagggcgagcatcacgccgacgaaggcgggattgacgaatcgtttaagcaggccgaggacgcgggtgcctggcgaggggcggacgatggccggagaaccaccgtttgcggcattgctcgccgaaccagcattgcccaccgaaccggcgccgttcaccgaaccgttcacgaccgcacctcgcgcgccaatcgcgttgccgccagtcgtttcgtcgaccggctcgcacagccatacgccgtacgtccagagcagcgtttggtcgatgatcgacatcagcgccacgtaaatcgcgccgttctgcggccaaagtgccataatcaacggaatgccgatgaatccggcgttgccgaaaataagcgacgcctgaaatacatggctacgcgaacctttgagccgcaacagttcggcgaccagccagaacaccaggatgagcagcgcgtacatcacggcggtcagcagcatcacgccccagttagaggcaagctgcgcgcggtccgcaccatcgacggcgttcgaaaacacaagcacggggatgagcacgttgagcagcaacgagcacatgccgtccaacgccgtctgaccgtagaatcgaagcctcacacatccatacccgaccatcagcatgatcagaaatccgactaactggccaatcatgacgccgaactgccccatgcacactcctctcgctcgcgttcccgtgcttttctgtcactggttcatataggcagccatctggacaggctcggcagcacacgcatcagtatgttcgataccaccacatgccaatccacttctcgttcaaccgttccccgtgctaatgcgccgccggccaccccgtgttgccggtgctgcgcgagcaccattacacgtattgcattccggtgatcagcgggcgcaacgtgtgggtcggcgcgaacgtgtcgattctgccgggagtgaccatcggcgacaattgcgtgattggcgccggttcggtcgtgacacattccatccccgccaactccgtcacctacggcgcgccctgcgaggtcgtgcgtgaaatcggcgacaaggaccgcgagtatttctacaaaaatcgcaagctcgacgtgtgggagtgagctttcgcgctactgctctttgagcttaaaacgctcactgaattggcggtcgcgccagtagtagacgtcgtcgcgttcgttgatttcgcgaattaccttgcacgggctgccataggcgaccgtgttggcggggatgtccttggtgaccagcgagttggcgccaatgaccgcgttgtccccgatggtgcccccgggcagcacggtgacattcgcgccgatccagacgttctcgccgatgtggactggcaacgaatactgggcaccctgatagcgcaggtccggacgcacgggatggccggtggctacaagcgtgacgttggggccgatcatggtgtgggatccgatgaagatctcaccatcgtccaccagcgtcaggttgaagttggcgtaacagcgctcgccccaataagtattgcagccccagttcgcatacaccgggcattcgaggtacagaccctcccccgccgcgccgaagaacgcctgcatgagttcggtacggcgcttcgggttggtcagcggcgtggcgttgagttcgagctggagatcacgctgggcggcctgcagatcaaaaaagccgtccacatcatccggcaggtagacctcgccagagaacataagcgccattttctcgcgcgtcgcatcatcgataatcggcttggcgatcggcttgtcttcggtcatcattggctcctgttcggcgttttggcgattgtgtcggtcgaactattctgtcacagactcgttttcgacacccagcatcgagcgcagccagtcaaggattcagatgtgcgattggcaccgtgcgggcctcacacttttcttattgagaacgattcgccgtgcagtcaagccctccatccacccaaaaaggactcgcttttggccgcgtcgtcgcggtaggccttgccgaactcgtcaataagcccatggaattcctgcaaatccttgacgctgaggctcgcatccagcaccacgggcgaataggccttgtggaatgccagatagccggttggcacatcaaatccgaggaaggcgaatagtcggcgagcataagtatcggccacgaatgtgcggcgcgaaaacacatatagcatcaggtcgtcggccgtttcgcccccgataccgaataatccgagcaattcggtccgcaattcggcgtcgggaatatctgccgcgccctcaggcgaggctccgcaacgctccacataccatcggctcagtgactgtaccgtcttggatttgttgacataaaagccggacgggcgaataagttcctgcagatgcgctggccccataatcgccagcttatggggttcgagcacaccctccgcgttcaacgccgcaagcgaacgattcacattgccccacgccgtattctgcgtcagcaccgcgcccaccataatctcgaatgtggtttcagccggccaccatccggtcgggccaagggcggcagccatggtgcggtacagcgattcgatatacgcgggagaaggaacgcccggcacccgctttgcacttcgattattcatagttgccatctaccattcaccgcaattcatgcaggattcgccgcatgaacgggatagtgactaggaatgtcagcacgtcggacaccgattgcgccatttccacgccgagcacgccaaatatcatcggcagaatcagcacaatcggtgccaggaacaggccttgtcggcacagggccaggaatgaggcgatgccggtgcggcccatggtctgggtcatcatattgcccatcatgttgaagccgttgagaatcaccgtgcagcattggatgtgcagcgcggccacgcccaccgccaccacggctgggtcggagcggaagatctcgaccagttgcggtgcgaacacccacagcagcgctgccaacgccacgagcacgcaggtggcgagccgcacgcagaaccaatatccctctttgactcgcgcgaacaggccggccccgtagttgtaaccacataccggctgaaagccttggccgagacccacgatcaccgaattggcgcccaacataatgcgcatcacaatggccatgccggcgatggccgcatcgccgaacggattggcggcaatgttcacgcaggtcacggaaatcgaaccggcgccttggcggatcagcgagggcaggccaccgccggccacttcgcgcatgagcagcacatccggcctgcaattgcgcagggacagtttcatcacgccgaatttgcggctcattgtggtcagaatcgtgaagctcaccgtctggcagatggcggtggccaggccggcaccaaaaattccgaggtgcagcacgaagataaacaacggcgcgagcaggaaattcagcaatgcgcccgaaaccagcccgatcatgccgaacgtcgattgcccttggtatcgcagcagtccgttgagtgcgaacgaaccgcatacacagggtgcggcgaccaacaacggcgtcaggtattgcacggcgtatggggcgattgtcgaggtcgatcccagcatgacgaccagcggccgcagggtcagcaatccgattgtggcaatcaccaaaccagagagcaccgcacccgcgaagcccacggccagtagtcgggaggcgcgctcattgttctgtttgccgagttcgcggctcatcgagttgcccgcgccgttgccaaagaagaagccgagcgcctgcatcacggtcatgatggagaacgcgatgccgatggcaccggactgcgcggtgccgagctgaccaataaagaacgtgtccgtgagattgtaggcggtggtcaccaagttggagatgacggccggcaaacacagtttgagaatcagcggcttgaccggctgcccggtcatctgccgatatttcgcgtccgcgcttgcgcgtctaatgccatgaatctgcaccatggacggctatcctactcgcgcagggtcctatgcaaaggcgcgttaccgccatacgagtcagcgcagataccgcccggtgatgctgttcggattggccgcgatttgttccggcgttccggtggcgacgatgcgtccgccgctttcgccaccgcccggacccatgtcgatgatccagtccgcattggcgatcacgtcaaggtcatgttcgatgaccacgactgttgcgccgctcgccacgagccggtcgaacacgcccagcagcacgcgcacgtcgaacgggtgcagaccgatggtcggctcatcgaacacgaataccgcgtccgattgggccttgcccatttcactggcgagtttcagccgctgggcttcgccgcccgaaagcgccggcgtcggttcgccgagcgtcaagtagccgaggcccaagtcgtgcagggtggtcagacgtgcgtgaaccttcttgaggtcgccggtcacggacagcgcctggtccacgctcattgccatgagttgaggcaggctcagggaaatgttgccgccaccctgatccgtcgcctcactcaatttttccttggcagctttgcgtttatccgggaccttcatcttcgccgctttgcccttagccgctttaaccgcacgccgaatcgcgtcggcttcggacgcatagcgggagcctccacaatccgggcattcgatggtcacgtccggcaggaactgcacatcgagcgagattgaaccggtgccgtcgcatgtggggcaacgcagtcggccggtgttgtatgagaaatcgccagccttccagccgcccgccttggcgccgtccgtgcgggcgaaggcgcggcgcaattcgtcgtgaatatcggcataggtggccacggtggagcgtacgtttgcgccaatcggcgtggcgtcgatgagattcgcacgatggatgccctcggcctcaagttcacgcacatgttccggcaaccgctcccccgccgcctgcgctttgagcgcgggaatcagcgattcgagcaccatcgtggttttaccggagccggagacgcctgtcaccgccacgagccggccgcgcggaatatcaacgtccagcggcttgaccgtatgcaactggctggttgtcatgcggatgcggccaaggtcgaacacctgcggttccgccacgcgctcacggatgcgcgcgctcacattatcggccaagaacggcgcaatacgactacttggattcgccgccacctcgccgaccgtcccttgcgcgatcacatgccctccttcggcgccggcaaccggtcccatttcgataagatggtcggcggccttgagcacgcgcacgtcatggtccacgaccaccacggaattgccgtccgccaccaagtcatgcatcacgccgagcagcccatccacgttcgaggggtgcaggccaatggacggctcgtcgagcacatacagcacgccggtggtgcggttgcgcacggcacgggcgagctgcacacgctggcgttcaccggttgaaagcgtggcaccggcgcggtcaagcgccagatagccgaggcccagatccaacagtcggcgggccacgtccaggaatgattcgcagatgttggtggccatcggccgcatgtcggcggacagagattccggcacgccgcgcacccaatccaccgccgcatccaaggtcatcgcgctggcttcggccaggttcagcccgcgcacatgcggggcccgggctgcggcgctcagtcgtgtgccgccacagtcggcgcatggtccctccttgagaaatcgagccacgcgcttcagacctttctcgtccttggctttggcgagcgcgttctccaccgtgtatacggcgttgaagtaggtgaaatcgagttcggcgaaatcgtcgcctttcttcggcttgtaaagaatatgctttttgacggccggcccgttgaatacgatgtcacgctcttcgggcgtgagctcgctgaacggcacgttggtgcgcacgcccatcgcgccgcacacctgcttcataaggtcccacatgagcgagccccatggcagcaccgcaccgtcgtcgatacttttcgactcatccggcaccagggccgcacggttcacttcgcgcacaatgccggttccggagcaggtcgggcaggcgccggccgagttgaaagcgagcgattcggcgccgggcgcgtggaattccttgccacagccagcacaggtgatgggcagtccggccgccacgttcagcgtcgactcgttgcgcgccccgcaatgcgggcacacgtgcgaggcaacgcgggagaacaggagccgcagactgttgagcagttcggtcatcgtgccgaacgtcgaacggatgccaggcaccgtgggccgctggtgcagggccagcgcggccggcacgtgcagtacttcgtccacttgggcgcgactggcctgggtcaggcggcgtcgcgtgtacgtggacagcgcctccaagtagcgccgcgaaccttccgcatacagcacgccgagcgccagagagcttttgcccgaaccggagacgccggccacgcccaccagttcgcccagcggaatgtcgatgtcgatgttcttgaggttatgcacgcgcgcaccgcgcacctcaatcgcctgcggccgttgatcgtcgctcatgctcggcactgctccgccgccgcaaggtcggctttcagggcggaagacagttcatcgagcagcggcagccatcgatccgcacgcaccgagcaaatgcggcgggtggcgtctttgctgatttcgatgaatccggcttgttccagcagtttgatgtgatgggacacggccgtgcgggacagtgccgacgattcggccagctcccccaccgtctgcggcccatggcacaccaattgcaccagcaactgctgccggttcggatccttcagcgtctcgaacagcggaacgcattggttgaggatttccaggctcctgatcggctggtcacatgcctcgtggcctgccgccgcgctatctgacctctgttcaagtgtcacgccgtcacctctttctcgacttcgcccttggctgccgccgcctgagtttcatggtctccagtatcatcacggccaacgacggcggctgaacgccggacgagaatctttcgtcttgggcaccgtccgccacctgcaatccgattccccagtttcactgatggcctttgcgccggcgcggtgtcagcgcacccatgccatgctgtttcagcgcgaatagcagcgcgcatgccgccgatgcgcgaatccggttccttgctggtcgggctggtcggcgagcggctgaatcttgattcggcgtcgcggcatccgatcatcctccggcgctacgcgctctcagcggggattaaagcaaaaaggacctcgtgaactggttttgatcaggcccctctatgctggactgtctgaatgacgacgagctgcacaccctatacggctacctgcagcgcatcatcgacgcctcctccgacggcgtaccggcttcgaccgccgaggacgccaagaagcgagcgctacttatcgagcaccccaagcgcaggcacatgacggccgaccgcgcataattcgcgaacagcccacacaactttgcggccacgcaaacgacggccgcgcaatcgttcaatcatttagttacaaggtcatccagccgcacgatcatccagctccccttacaagcacgtccaattcaccatttacacggcattttgcaccaaaaccctactttaaaatgcggcattttgcaccaaagccccattttgaaatgcggcattttgcacatacaaggcagaaaatgctaccctcataagggattcggaaaggagctgccatgcttgagcgcaaaatctcggacgatctgctggaatggaagcggagcggtaccggcaaagcactgctgctgaccggcgctcgccagatcggcaagagctacgcggtacgcgagttcgccaagcacgaatacgcccattaccttgaaatcaacctgtacgagaacaagcaggcggcccgagcgctcgcatcggcgaacgacgtgcaggagttcatcagccgccttaccttgttctcaccttcaacgctcattcccggtgatacgttgattttcatcgacgaggtgcaagaggcaccggatgtgatgaccatggtcaagtttctggtggccgatggccgtttcgattatgtgttctccggttccatgctcggcactgagttcaagggcgtacgctcctaccccgttggctcggtcatcgaaaaaaccatgcgtcccatggattttgaggaattctgttgggccatcggcgtacagaagtcgacacttgaaaacatccgagaatcctgccggtcggtcacgccaatcgaccggtacattcacgatgcaatgatgacgaacttccgcacctatctggtagtcggcggcatgccggaagtcgtgcaacgttttctggacaccaagggtgatttggcggctgtgcgcgcggtgcagaacgagttgaaccggcaatatcgccacgatatttcgcagtacgcaggcaatcgcgcattgcaggtgcaggagatcttcgaccagctccccactcagctgattgacggtaacggcagattcgccgtctcctccatcagccccggtgctcggtacgaccgcaatcagaaggattttctttggcttgtcgatgcgggtgtggcattgaaaaccaactgcgtcaccgagccgaaaacaccattgaaacgcacggcgcaatcaccgaagttcaaactgtaccagtctgataccggtatgctcatggcacgatacccgcaaccgaccgcgcaagccgcataccttgatgattcctcaccgaatctgggtgccatctacgagaacgtgattgctcaggagctgacggcgcaaggcattccgctgtattactacatggcaaagaaacatggtgaagtcgatttcatcgctgacacgaacgccgattctgtgatgccgttcgaggtcaagtcggggcgcagctaccgcacgcacgccgccatcgacgccgtattggccaatgccgaatatcgcatctcgcagggcgtggtgctgtcccgctccaatattgcgcaggacggcggaacaacctatcttccgctgtatgccacgtactgcttgcgagatgtctgcaatctggcctcaccctcgaccgtcagcaccatcggcgacttttcgctgacggtgcaccccgtgtaggcttcgcatcggtgcgcgctttaccactgcgcgcacagggcgttgaaggcgtcatcgaggctcgcgccaagccggcgggcctcgtcggcataggtcttggccgcgcgcaccagcggttcgggaatcggcttgacccgttttacacgcgccgcgcggccggcaccggtgtcgatgatgccgcagtcggcgagttcggtgtacgccttggccacggttcccgacgcgatgcgcagtgtccaccggttcgccggaatcggcctaccagaccggcaccccggccactaccccatcgagcagctgcttattccgatcgagggcacggcttatacatcggcgcgacctgactcaagccgttcgccacgtgcggcgctttcggcatcaccgacgaggccctcgcccagtccgctgcacagtacaaggcactgctcgccgagtaacaggtgaccggtttgcgtcaccacaatcgttcagcgtaaaccgcgtcagacacatcacaacgtccgtatgtatgcggccctacaaaggggacgcatacatacgggcgttaaataccactgcggtaaaccccgtcacaccacgcgattagaaccggatcaacgccttaataactttgcgctggtccatggcctcataagcgtcctgaatatggtcgaggtcatattcggcggtgaacacgcggccagggttaatctcgcctttaagcaccgcatccagcagaccaccgtcaatatcgtagtggcgcacgggagccgggccgcctttgatgccgatgttgccgtagaacgtgccttcggcgctgatctccacgtcgtgcggcaggcccacacgaccaatcacgccaccgcggcgaatcaggccaatcgccgtgtcgaaggactgcttggagcccacgcattcgagaactgcgtccgcaccatagccgccggtcatctccagcaccttgtcaatagcctcttggccacgctcgggcacgatatcagtcgcaccgaattcgcgggcgagcgccgcgcgatcctcgtgacggctcatggcaataacgcgcgtggcaccgcgcatcttggcggcaatcacaccgcacaggccaactgcgccatcgcccatgaccacggcggtgtcaccgggcttgacctcggcagaaaccgccgcgtgataaccggtggacatcacatcggaaatggtcagcagcgatgcgagctgctcatcggaataatcttccggtgaaccgggcaccttgaccacggtgccgtccgcctcgggcacacgcaggtattcggcctgacaggcggagaagtagccgccgtgcgggcacacggattcgaagccggccttgcataccgggcacttgccgcagctgtatgggaatggcacaaccacgaaatcgccgggcttgacggattcgaccgccgcgccaacctcttcgaccacaccgatggactcgtgacccacctggctgtgtgcggcctgtccgctcagcccacggaagaaccacaaatcagagccgcacacgcacgtgcgcaccacgcggatcacgatgtcatcatcctgttcaagcatcgccttcggcacttcttccacggtcatcttgccaggctccacgaaaatcgcagctttcatggtttcagacatattcacaactccttgtttccggcaccgagcgattagggcccgttatcctcatgttccattaaacgacaatcgatctgtattagccaatagccataaaccatgttgagccatacccacgaggtatggaagcaaccaagcaattcatctacgtgctttatcgcctcacggcaaccaagttcatcggcgttgcagaagtctcttgccgaaatccaccgcgataggccaatatccgagatactgctgccgtttgttgtcgccgccacgagtaggctaaggaaccggcgatggaacccgcctgaactcgtttcgaaccgcacactgctgatagttcctacacacgatttgatattgcatggaatcgttgtgtcttcagcaggattcagcggtttcaggaaaggctattatggattcgcaatccccatccgcaggtgcccggccgattacgcacacgaccactcccccggcgcgcaagctccccgatattcatcttgatattgtgttggtcgtcttctgcggcggtgcgatcggcaccgctatccgctatgcgttcgcacagattcccgcggctggcagcttccataccggcacgtttgtggccaacatgctggcttgcttctgctatgcagggttgaccgcttacttggccggcgcttcccggttcggcgcacgttccaaagaacttgccagtcgcggactcggcatgggcgtatgcggtggtttgtctacgatgtcgacactcgcgctggaaggttttaccgcaatccgcgacggtcaggtggcggccggcattgcctatctactggtgacgttcgcgctgggtctggtttgtgcgtctgccggcgtgtgggcaggaacgcatctggccggctcctcgaacgtatccgccgaagcgtccgctgatacgaatgccgctacgaccagcaagggaggtaaggcgtgatgaccgtattcctaccaatcttggtctgcctgtgcggcggcgtaggcgcctcctgccgctatctgcttgacgtgaccatcaaaacgtactggcagcgcgcattcccactttccacgttcaccatcaatctcatcgccggattcctagccggtttggtcgcggcgctggcactcggcgggacacttgatgaaccatggcggctagtgctggccaccggtttcctcggcggcttctccacgttctcgaccgcaatcaacgaaatggtgacgctcttccgcaaacaccgctaccccaccgcagcggcctatctggtgctgtcgctgggtgtgccggtcgttgctgcggcctgcggttttctcgtctgaccgccacgccgattcccgacgcggtcagcggtatcattgcgaggtcgaacgtcacaggtacatccgggaggtatatgggcatggcgaacaatggagcggatgtgaagccgaatcaaggtgtgggcgccacaaatacctcgaccacaacgaatactgcggaaaataccgtgggcacggcaaccccgaagcaaaatggactcgccgtgctgggcaagtatgtgggtgtttccgccacgcagaccattgtggagtatgcgacgttcgccattctgcacttgatcggcgtaccctcacagatcgccaacggcatcgccgtggtgtgttcggcgacctacaacttcgtgatgaaccgcaacgtgacattcaaatcgtccagcaacttcacccgttccgtggcgctgttcgtgctgctgtggatctggaacttcacgttcagcacgctgctgatcggctggatgccgggtgcgaccgggctgagtccatatgtggtgaagttcattgcgatggcctgccagttcggctggggttatccgttgtgcaagtacgtgatttttaggtgacacattccaattgctcactgtcgttcgccttcgcctatttgtatttggagcgcttatcagaagaacagcatcgcaacacctgcagcgaagcacatgagcagaatcgatgtcaggaagctggcgagcatcggcttcttgcccttggaagcgatggccttgaagttcacgttgatgccgagcgcggccatggccatgccgagcacgatgtacgcaaagtccacgagctgcggggtgatggaggtgacgaacggtacgaaggtgccgataatcgaagcgccgatgaagccgagcatgaaccacgggaaggccacggtcttcttgccggtgctctgaacctcggaatgcttcttctcccaccagatggcgatgatgatggccgcgaacacaagcatgagcacgcgggaaagcttcatgatggtggcgatgtccaccgcgccgaaagcgtcgccggcggcgaccgcatgggcgatttcgtgcagggaggcaccggcggtgatgcccagctggtccttggtcatgccggtcagcgggccgagcgcgatctccagcaacgcgaacacagtacccataatggctacgatggccacggccatggtcacgtcgttgtccttctcgtcctgcttgtcctcagacaccttgatggaaccggccagacccatgacggcggccgcaccgcagatgccggtgccaccggcggtcaggatggcgagcatcgggtcgacaccgagcttgcgggcgatggcatagcacacgatgatggtcagcgtgacgaccacagcggcgatcggcagacacttgatgccctgcgtgaacagcacggcgaggttgagcttgaaaccgagcaggatgatgccgaggcgcagcagcttgttggaaatcaggccagcggcgtccttgacgcctgccttgcggccatcattggaaccgacgtaggcactgcggatcgggaactggatgatcataccgatgagcagcgcgatgataagcgcgccgaacaggctgaatccggggaactgcttgagccaggaggcgaacagcgaagccagcagagtcagaacgccaatgaacaacatgtcaacggtggtaatgcgcttccaccattttgtacagaactctctcacggtgtctattgaagctcaagcatttacatcggtcaaatcattgctaccaatacatatcatcgattttgtcgatacctaattgatctccctctgatgagggaggtggccgccgcaggcggacggagagagagaaacaacgttcgcgacctcccctcagtcgactatctgactacccgcgcagcgcagcaataatcatctccgccaactcccgctgatcgtgcgtcagaccggatctcggcaccagcgcatagaaccgccgcacaaactcatcgccaagctcccgctgcaccggcacgcccgccggcacggcggcttccgaaatcaacgactgcccgaacccggcggacagcgccgccacaatcgccgcattactggacacttccatcgtgcgtgcaggcacaacctgagcggtcttgaaatacaaatccgtgtaataccgcacgccggaaccgtgctcgcgcaccatccacacgccgtcgggctcccccgccaacaccagccggtcctcgcacagggtgacgcggtccaccgaatcgttcacgatcggcttttccaccacgccgagctgcacggccttcatgctgacccgttcgagaatcgcatccgagttcatcacgtgtacggcgaagtcgaaactgtccatgttccgagccatcaccggcaacgccttcggcagcagaatcgccgcggtcgtgtgcgagaacgaaacggccagcggctcacgcgcctcctgcacgcgggcgatctgctcacgcgtatcccgccataatccgtcgatgccgatggcggtctggtacagcatccgcccggcctgtgtgggcgtcacgtcgcttttcgcattgcgcacgaacagcggcgcgccgaccatctgctccaattgggcgatacgcgacgacaccgtcgactgcgacaccttcagttcgtcggcagccagcgtgaactggcccacctcgtatacggcgaccagggtttcgagcagagggaacatggtttaactgtacgctgtatgatgcacgaatatttcaattagcttaggcgtagccctaggccacggacctggaccaccctcagtctcgctttgcgagccagctcccgccagcgggaccccaatggttttcgtatcactatgcttcgcgcagttttgcgagctgtgttttggccttgtggagcttggcatagatttcattgcgctgaacaggattcttgacgcgctgatggtcgcgggtgagcttgtccacttcggattcgagccgagcaatttcagtatggcgaatgatgcgcgcatccagattctcgacctccggcgtacccaaaatggtctgtgagcacagcgatgcccacagctcatcaatagtagagccggccagctccagctgggcctcccccgccggctgccagtcgccggcatatacctgatagatcggcgtgtgcccggcacgccccggtatggcgcggcgcacggcgaacgcgcattcctcacgcgtgctgccctcgaacggcacgtcgcgtacgcacacgaacacgatgcccgatttgcgctgtccggcgatcaggtcgatgacttcgttcggtatgccggtggctttggccgtaagcttcagtccgatgaccagcacttccgggatcagtttgccgtccgcaagccccgtgttggccgaccgggccaacgccagcatggtgatggattcgatctcgttcaccaatcgctgcttgagtttgccggaaatcggcgctttgcctacgaacaaggctttcggcagtgtgcctttggcttcgggaatcgccgtggaaacgggcagtcccagcgaaattgcggatacagaaccacagtgagcggcctgtgcaccagtcatcatcgaccttctttcccggcctgccatcagtgtcatatcctcgcagtgcagcagtccgtttatctattgaaaagcaacactagcgcatccaggccggaagtcgtggtacatatccatatcctgctgcggttatagaaaatcccctccgagtttcctcgaaggggatttcctataacgctagttcaagcgaagattcttgtctgatgaaaatcaggcgaggatcttggtcacacgaccggagccgacggtgtggccaccttcacgcacagcgaaggtcaggccttcctccatagcgatgggctgaatcagctcaacggtgaaggtagcgtggtcgcccggctgaaccatctcgacgccttccggcagctcgatgacgccggtgacgtcggtggtgcggaagtagaactgcggacgatagttggagaagaacggcgagtgacggccgccttcgtccttggtcagcacgtagacttcgccctcgaacttggtgtgcggggtgacggagcccggcttggccacaacctggccacgctcgacatcgtcacggccgagaccacgcagaagcagaccggtgttgtcgccagcctcgcaggcgtccatggtcttgtggaaggtctcgatggaggtgacggtggtctgctgggtcggacggataccaacgatctcgaccggggtgttgacggccagctggccacgctcgacacgaccggtgacaacggtaccacggccggagatggtgaagacgtcctcgatcggcatcaggaacggcttgtccaggtcgtgaaccggggtcgggatgtagtcgtcgacagcgtccatgaggtccttaacggactggacccacttctcgtggtccggagcgtcgtcgtgcagagcaccgtaagcggaggtgtggatgaccgggcagtcacggtcgaagccgttctcgtcgaggaggtcgcggacctcttcttcgacgagctcgatgagctcttcatcgtcgaccatgtcgcacttgttcagggcgacgaggatcttcggaacgccaacctgacgggcgagcagcacgtgctcgcgagtctgggccatcgggccgtcggtggcggccacaacgaggatagcgccatccatctgggcagcaccggtaatcatgttcttcacgaagtcggcgtggcccgggcagtcgacgtgagcgtagtgacgcttctcggtctggtactcgatgtgggcgatgttgatggtgataccgcgggcggcctcttccggagcggaatcgatctggttgaagtcgtactccgggttgacatccgggaactcctcgtgcagcaccttggagatggcggcagtcagggtagtcttaccgtggtcgacgtggccgatggtaccgatgttaacgtgcggcttagtacgctcgtacttttcctttgccattacttttgtcctcctggacgtctcgtgagtttcctgcaccctttcgcacaggaactcgcttattctactgggtttctgggttatgtgccactttgaagagccagaacccagtcagcggtatacgatattaccgctgactgaagacactggctacttcatgcagtggcgcgtgtcactcgccgcgctgggccttgatgatctcctcggagacgctcttcggcacctcgtcgtaggagtccatctccatggtgaacatggcacgaccctgggtcttggaacgcaggtcgccgatgtagccgaacatctcggacagcgggaccttggcgtcgatgaccttgacgccgacaccgtcggtcatggactggatgttgccacggcgctggttcagatcgccgatgacttcgcccatgtactcttccggcgtacggacttcgaccttcatgatcggttcgagaatgaccggcttggccttcggggcagcttccttgaagcacatggaacctgcgagcttgaaggccatttcggaggaatcgaccgggtgcatctggccgtcagtgacggtggccttgacgcccacgaccgggaagccggcgagaacaccggactccatggcctccttgacaccggcctcgatggggccgatgaattcggcggagatgtggccgccggtgaccttattctcgaactcgaaggtcttgccctcggtggtgtcgagcggctcgaagttcatcaggacctttgcgaactggccggaaccaccggtctgcttcttgtgggtgtagccctggtccatgacggccttgcggatggtctcgcggtaggcgacctgcggcttgccctggttgcactcaaccttgaactcgcggcgcatacggtcgacgatgatgtcgagctggagctcgcccatgccggcgatcagggtctggccggactcttcgtcggtcgtgacctggaaggtcggatcctcttcggccagcttggacagggcgatgcccatcttctcctggtcggccttggtcttcggttcgacggccacctggatcacaggatccgggaaggtcatggagtcgagggtgatcggatcgtcgatggcgcacagggtgtcaccggtggtcacgttcttcaggcccacgaaggtgtagatgttaccggcgtcagcgcggtccatcgggttttccttatcggcgtgcatctggaagatcttgccgatacgttccttcttctcgcgggtggagtcgagcacggagtcgcccggcacaacggagccggagtagacgcgcacgaacacgagcttgccgtagaacgggtgggtggagatcttgaagaccagagccgcgaacggatcggacttgaccgggtgacggtcgatctcgacggactcatcgccaggcttgtagcccttgatggccggcacgtcttcaggagacggcaggtaatcgacaacgccgtccagcatcggctgaacgcccttgtccttgaaggcggaaccgcagaagatcgggaaggcttccttggcgatggtgagcttacgcacgccagcgcggatgtcttccttggacaggtcgccgtcctcgaagaacttgttcatgaggtcgtcgtcagcttcggcagcggcttccacgagcttctcgtggtactcctgagccttgtccttgaggtcgtccgggatctcagtggtgtcgtacttggcgccgagctcctcggtgccgttccacacgtaagcctgcatctcaaccaggtcgacaacgccagtgaagtcgttctcggaaccgatcggcaactgcatcacgatcggagtagcgcccagcttctccttgatggtgtcgacggagtagtagaagttcgcgcccagcttgtccatcttgttgatgaagcagatacgcggaacgccgtacttgtcagcctgacgccacacggtctcggactgaggctccacgccttccttgccgtcgaacacggcaacggcaccatcgagcacacgcagggagcgctccacctcggccgtgaagtccacgtggccaggggtatcgatgatgttgatctggaacttgtccttggtgtcgtgggactgacggctccagaagcaggtggtagcagcggactggatggtgataccacgttcctgctcctgcgccatgaagtccatggtggaggcgccgtcgtgggtctcgccgatcttgtagttcttaccggtgtagaacagaatacgctcggtagtggtggtcttgccggcatcaatgtgggccatgatgccgatattgcggacgtcgtggaggtccgaaatctcttcagccatctttttccttagttttactcagggcgagtgattaccagcggtaatgagcgaaggccttgttagcctctgccatcttatgagtatcctcgcggcgcttgacagaagcaccgaggccgttggaggcatccaggatctcattggcgagacgctcagccatggtcttctcacgacgggcgcgggagaagtcggtcagccagcgcagcgacagggtgttggcgcggttcggcttgacctcgaccggcacctggtaggtggcgccaccgacacggcgggagcgaacctcgagggacggacggatgttgtccagggcgcgcttgagcacagccaccggctcctggtcggacttctccttgaccatatcgagcgcggagtagacgatgtcttcggcgatcgacttcttgccgtcaagcagaatcttgttgatgagctgcgccaccacggtggaaccgtagatcggatcgggcagcacgacgtgcttcttggaaggtcccttacgtgacatatctcttacttcgccttctttgctccatacagggaacgaccctgcttacgatccttgacaccctgggtatcgagcgcgccacgcacgatgtggtaacgcacacccgggagatccttcacacggccgccgcgcacgagcacgatggagtgctcctgcagattgtggccttcgcccggaatgtaggcggtgacttcgatgcccgaggacaggcgcacacgagcgaccttacgcagagccgagttcggcttcttcggggtggtggtgtagacacgggtgcacacgccgcgacgcagcgggctgcccttcagggccaaagtcttggacttcttcggctttgcctgacgtcccttacggacgagctgttcaatagtaggcaacttgaattctccgattcagtggtttctcttgcttttgtgtgaccgccgcactgcacccacacttttcagcacactcgcttggtatccgcctgttggcggcacccgacgaatcggaaaagatagcccagtccaccggcccgatggccttcgcccctcccgtcggcgcattactgcgtgcgatcagcggtttgaaggatatcccagcatgctcgcctgttacataaggcgtgctgttggcacacacgaatatctatattacgattcctccggacaacgacgcgccgagccacaactcactggtttggggacctcctgcgcccccgtacttttcctctcctcccaacgcaatattccaatgcgtcgcaaaacacacacccaactattctcccaacgcaatattcccgggaatgcgtcgcaaaaagggaacgccacacagcaggtgcccccgcggagactatgtcacacgggggcaccgccaaggaggttacattatgtttcttttcaccacatccgcttctgtgttatctgtttccagcacatcctcgtgctcttccatatccgatgggaacctctagcgacccggcctctttgccgtattaccttgccgctttctgcattaccaattatagcaaaaccgccctcgcgaaacgcccgagccggattcaatttgtaagcgcaacgcttgtgttcgggctggctgccttcgattgtagcttggcgatctcctcgtcccatacctcgttgggcgttttgtagccgaggagcttcatcggggtgtcgttgatctcaccgacgatcgcgtcgaggtcctcctgggccaagtcctcgaacccggttcctttgggcagatagcggcggatcctgccgttcctgttctcgttgctgccacgctgccaggaactgtacgggtcggcgaagtacgtgagcatgcccagcgcctcgtccaccagcatgtgcaggctcgcctccgtgccgttgtcccacgtgcggtcgacgcgcgcggccggcgggatgtccttgattgactataaagaagtagtacaaacacgctcttgagttctcaaaccaccaccactcacccacctcgcagctccccggaggagaaccactcgctgagcggcagcaagggaataacttacacgcattcacggactcgcgcaaaccgggcacgaaaaaacacgccagaatcgttgaaacgacaggcttcgcccggcgtgtcgaaatcagcttgaatcacgccgttaccatcaggatacgccggctttttatgggctcacgtaacgaaatcagatgttcaccggcgtgtcgcaacaatttattccacgttcaactcccctcagtccgatcacgcggacggttcacccgcaaaaagctctcgtccttatggctcgactatcgtctcgccttcgtctaaaaaacagtccaccggactgttttttagacgcctcagcatcaaagaggggaaccaaagggggattagaaggtcaggcgcatctgatgccagaccacgtcaccgtgagtggactccgaaatgccctcgtcctcatacccaaattgcgcatagaatccgaccagccgatctttgcaggtgagcaccaggcctttacgtccagctgcacgagtgtcttcaatgactttcctcatgagtgtactggcgcaaccgcgatgctgatacttcggcgcagtatccacgccgaaaatcatttgccagtcaccttgagggttgtgctgcgcggcatcctcgtacatgtcatcggtcaagtcgcgccgatcggtcgcgaaaccgttgatgaacgccatgacgatctcgccatcaatcaatagccaaaaacattccggataggtctcgattcgggcgcgcagggacgagcggtcggcggcctcggcggccgggaagcattcggattccatggcggccagcgcgtccagatcgtcgatggtggcgtggcggattaactgggaatcagaatcagtcatgtttttgtctttctcttaacactccgttgtgagcaacttccctcagtcacgcttcgcgtgccagtcgaggggagccagatggatgtcagattacgtggtattcgcgtaacagggtggcaatatcggtgccgtcgagtttcttgagcaccttcttgaccacggccttttcaatgaagttgagcttcatatcggtgaccggtgcaccgtcacgcaatttgacggtggcgttgagcaggttgcgcacgtcatagacgctaccccacacttcaggcacgccgcggtccacgccgagcaacgtgtagacagcttccataccggtgcgcatcgagtattcggtggtgaaaatcgtgtcgcgcggggtctcggcgaactggccaaggaatgcgaagttcacggcaccatcgggcaccacgtccgggcggtcgccggccgcgcgcggcatgaagaacgcggtgatgtacggcatcatgaccggcacggtgttggcgtggtgctttgcgagcgcctcgatcttgtcggtcggcacgcccatgtggtaaagccactcctcgcaaatctcttcaccggtgcattcggtcatcggcttcttcacatagttgccgggcttgtccgggaacaggccgtagacccatacgcacagctggtccttgggctggtcgcggaactgctgctggcggttcagggtccaactcatgagccagttggagtcctgcacggtgacgatgccgccggtgacgaccttgccggagaacgggtcgcgcttgcagatcttctggatgtacggcggaatctcgccgtccagggtggtgacggtggcgctcatccacttggtggcattcggatcggagcagaacttctccggatggccaaagctcgggtcctggtcagcgatacgcttccacatatcccagccgccaccgggcttcaggtctgggttccatgcggcgggcgagttctgggaacccatggtggagttctccacgcaaccgccgttggtgatgaacaccagatcgttctcggtcaggtcgatggaggatttatcaccctcgtggtccacgtcgatgcgcacggcaagcttcttggtgggcgtgctggcagggttgcgcttgaagaagccggaggtggcctgaatcttctggatggtgtcttggcctacgccggtgtgctcgcgcttggggccggctcccccgccaatcgcgaattccacgttctcgaccttggtgttgtagcggaattcgacgccgtgcgattccagatacttgaccatcggcagaatcatcgactcgtactggttgtagcgggtgaaacgcagcgcggaaaagtccggcaggcctccgatgtgatgaatgtagcgcttgatgtacagcttcatttccagcgcggagtgccagttttcgaaggcgaacatggtgcgccagtacagccagaagttggagttcagcacctcatcatcgaagaaatcggtgatcggcttgtcatacaggtcttcgtccggggtgaagaacagcttcatgatttccatcgaagccttgtcggacagcccgaacttgcccttgagccccgcgtccttgccgagattcttggtggcgcggcacagcgagtagttcgggtcctccttgttgagccagtagtactcgtcgagtacgctgacgccttcggtttcgatggagggaatcgagcggaacagatcccacatgacctcgaaatgattgtccatttcgcggccgccacgcatcacatagccaaggccgggaatatcaagaccgtcacaggcgccgccgggtaccgggtccttctcaaggatgtggatgttctcgccaggcatctgaccatcacgcaccagataacaggctgcagacaatgccgccagtccggtaccgatgatgtatgcatgcttgttgtccacgtcggccggcttcttcggacgtgcgaaagcctcataattgccgctgctgtagtacatattccgcctccttggggcagagttgacacttcatcaactcttcttgaatagacatcatgtcgcattattgacgaacgcgctataggcaacgttcggcgttctgccgcattcgccaataccttgcatctacggttttcgaggcctatgttggctgttggcccataactattgaaggcatacaggcatactgaggatgcggggtgcttcaccgaaccggatgattgataaggtcccgttcaatccacgccatgaccaaatcggcaagtcggtttacctccgcttcggcgagttcacggcctttgggcagatgatgccatttttcgatgcatccgcggcagcatgtggcggtagcatgctgagcggtgaataccggatggccgcgccatggcgtctgtctgccgtcgttcttcggttcggctgcgcctatgcggtctcgcaacatttctcgcgcatgacgatcgatggtcgccttgcctttggtgcgggcataggctcggtctttgtcggtcaaagcgaatttggcgcggaactgcgaatgagacagccgttccagcatcgtggcaatccattgttgctcgtcatcgttgttaccagtatccgctatctccatgcccatacgttccacagtagtcgcgcacatcgtatggtggcacacgccttagctccctctgatgaaggagcccccagcaaagccaggtgagggagaggccaggggcgaaacccgccaatcaggcggcaggcaagcagctggggccaaacagaatcttgatctcagcaaacaacgaagtatctcgcttgacgcggaaacgatcgccaaacgtgagcacctgagcgttacccttctcatccagcaccgcaagatgtacttcgcagtaaccaggatgattagcgagcacctgaccgagttgcatcatgcgttggcgctccaacgccaccgacggcagcgtgatgaccaacggacgttcatcctcggcttccaaggtcggaatctgcatttccgtggctctcagagaaacggtttcgtcgcgcaactccacttggccacgaatctgtacgatggcgtccacggcaagttcagcggcggccgcttcatagaccttgccgaagaacatgcattggatggagctttccatgtcttcgatggtcacgatggcccaggggttgcccttcttggatacgcgccggtccacattggtgaccaaaccagccaacgtgacctgctgtccttcacccatcgttttggctcgatcaaccagatgcgcgatggacatttcacgcaaggacgcgagaatcgactgcataccggagagcggatggtcagacacatacaggcccaacatttcgcgttcgaagttaagtttggtcttcttgtcccattcctcaagatcgggtacggtcacggaagcgtcgcccatggcctccgctcccccatcctcggcatcggagaacaaatcgaactggccctccgcctgtttgcgcttcagactcaccaccgaatcgatggcggcctcgtgcacggtgagcagcgcgcgacggttcgggtcaatcgagtcgaaggcaccggccttgatcaacgattcgaccaatcgccggttcagcgcggtcaggggcacgcggcggatgaagtccatgaagttcacgaacttgccgcgcgggccttcgcgttcggcgatgatatcggccacggccttgtcacccacgttacggatggcaccaagaccgaatcggacgacgtcgccgactgccgagtactcgtacaccgattcgttgacgtccggcgagagcacctggatgcccatgcggcgggcctcgcccaagtacagtgcggtcttgtctttgttggtggcggcaccttgcaacagggcggccatgaattcgaccgggtagtgcgtcttcagatatgcggtccagtaggagatcagaccgtatgcggcggagtgcgctttgttgaaagcgtagccggagaacggcaccagaatatcccacacggcctgggaggcctcttcggaatatccgtgctccttcataccggcgaagaacggcaccttctccttggccagcacttcgggcttcttcttacccatggctcgacgcagcacgtctgccttgcccagtgaataaccggcgaggattcgggcggcggactgcacctgctcctggtagatgatcagaccataggtctcgtcaagcacctgcttcagaggctcctcaagctcagggtgaattggcgtgatcttctgcaggccgtttttgcgcttggcgtagttggtgtgcgaatccatactcatcgggcccggtcggtacagggcgataagtgcggaaatatcgttgaagttatcgggcttcagggttttcagcagtgaacgcatgccgtcggaatcgagctggaacacgccgagcgtgtctcctcgggacatgagtttgtaggtttcggcgtcatcgagcggaatcttggtgtagtcgatggcgggtttgccgttggcctcgatgttcttcagggtgtcgtggatgatcgtcaagttggacaggccaaggaagtccatcttgaccagccccaacgtttcgcacgtgtggtattcgaaggtggtggtgatggtgccatcggtgcgttccagcaacggcgaggtgtcggtgatgggtgcgctacccatgatggtggcgcaggcatgtacaccggtctgtcgaatcaggccttcgatacccttggcttcctcggtgatgcgcttggtgtccgggtcggaatcgtagagttctcggaattccctggcctcggcataacgtttggcggccgggtcgaagatgtcatgcaggctgatgtctttgccgccggtggccgccggaggcagcgccttggtgattttttcaccgactgagaattcataacccatgatgcgggcggagtctttcagggcctgcttggttttgatggtgccatagatcacgcactgggcgaccttatcggtgccgtatttttcgccgcagtattcgatgactcgcgcacgaccttcagggtcgaagtcgacatcgatatcaggaaggctcactcgctcagggttcaggaacctctcgaaaatcaggccatgcttgagcggatcgagctcggtaatgcccatggaataggcgaccatggcgcctgcggccgaaccacggcccggacccaccataatgccgtggtccttggcccactgaatgtagtcggcgaccacgaggaagtatccgcagaactgcatctggcaaatcacaccacattcgtagtcggcctgcttcaatacgtcgagcggcgggttgccgtcgtaacgcttctccagaccttcctcgacttttttgaggaacagggaggtctcatcccagccttcggggcaagggaatttcggcatgaacgcgccgtcttcgtggtcgtcgaacatcacgttgcagcgttcggcgataacgagcgtattgtcgcaggcgtccgggtggtccttgaacagttcgcgcatctcttcggcggttttgatgtagtagccggtgccgtcgaacttgaatcggtccggatcgtcaagacgggaaccggagttgatgcagagcatggcgtcctgtgcgccggcatcttcggcgtgtacgtagtgggaatcgttggtggccagcagtggtgcgttgagtttcttggcgatggtcagcaggtcaccggtcacctgagtttcgatgggcagaccgtgatccataagttcgatgaagaagttgtctttgccgaagatgtcctggaattcgccggcggcgcgcagggcctcatcgaattgaccgaggcgcagacgggtctggatgatgcccgaggggcagccggaggatgcgatcacgcctttggaataggtggcgagcacctccttatccatacgcggataacgcatgacgcgaccttcgaggttggccacggacgaggctttgatgaggttgaccaggccttcgtcgttttcggcccacatggtcaagtgggtgataagaccaccaccggagacgtcgtcgcggcgctgggcttcggtaccccaatgcacgcgggacttgtcttgacgtgcggtttccggggtcacataagcttcgatgccgatgatgggcttgacgccattggccacgcagttggtgtacatctcgtaggcgccatgcatgttgccatggtcggtgatgccgaccgcaggcatgccaagttcggccgcacgcttggccaaatcaggaatcttcgacgcaccatcgagcagcgaatagtgcgtatggttatgcagttgcacaaagttgttcccgtaatcagccatgcgctctaccataccgtgtggtctgggcggcggtaaatatttaccggtgaggccacatgcctataaagtggagtatcagcaacagcgacactaaggcagtgataacgatgaaatttgaagactactctcccgagatacaggccaaactcatggaaatcggcaacgctgcggcagatgccgtggagtctcaggaatcaccagcagaaggcattcccgaggacagcccaaacttctctcccgaactggagctcagccgtctaatcaatcgacgcaaagccgaactggaatacattgatgcccgcattgcgcagatggtactgctcatgcatgaacgtggccaatcatgggaaacaattggtcgcaagctcggtatcacgggtgaagctactcgtttgcgatatgccaagatggagagaccacggcaataactgtagtgccagctgagttcgcgaatcatctcggcgagagaggcttcatcgctaatcgtcatattagtcagttcagacgctcagctcttttgtcggcactcggcaatgagggcggcacagagcaaaatgacctgggcgacgaggttgaaccaaatgagcacgccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcaaaattcagcgcgacgccggtaccgaaaccggtcatctccaaaagcacggtgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcaccgtccaccagaatatggccaacgtggccagaccggtccacgtcaatgcgcttgacatggtgcctagcgcggaagacgtcagaaacgagtcggccacaccgggaatgacttcacgcaccgcgtcgatcagcatctgctgccaatcaatgttgccgaccatgataaggccgaacacgctcaccgcaatccagacgccggcaaaaaaggcgaatagcagaccatatgccagaccattcgccagcagggggccgctccgcgacacataccggtcgagcacgcgcccaggcagcgaacgcgcccacgcgtccgctcccctgtcaatcgcactcttcaacccatacatagttcaactgtagccgttgtcaccgttgttgaaacagcatggcgcgaaatcgcatttagccagcccaaacgatggcaaccatcaacgcccccactcaattgttcagaatcggatatcatatgagtattcagttcatccgtcggagttcaatgtcagcagtcctcaccaactgatgtcttgctaacccgctggccgccctagtatctactgtttcttgtggtcttcgttcaacagccagtcaagcgcgtatacctgtcggatgccttttgcccttgatgtcgtatcggtgggccgggtagaggatgaacgcgtcgtaggccgcgatcgtcgccggaacgggcacggtcaacgactaggaaacggtttttatcagcaggagattctgcaatccggatggcatataccgcccggcttcattactgctttggctcttttctgttcacttcacgctggagtaccaagacacgttgcggaattagtccaccagaacttcggcatattcggcaggttcagcgggttcgatatgtcgggcacgcatggcatcgagggcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcaccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccaggaccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcacgcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtttcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcgatgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagagacctgagcacgaagctggttttcacgctgcttggcttcttcgagctgacgggacagctcagcgatctgagcggactgctgctgagcggcggaaccctgctgctgagcagaggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgagcggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttaatgagccatgcaagaatgcggccgatcagagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcacggccgaccagttgagcatcctcatatgacttcggatggatggtggtgattctgttcacacggccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccggtagccggtgtgaatgccggttgggcagtggcagcaggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatggccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacatgaatataggaattcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcccccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggtggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgaggcactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagggggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatacggtgacaggtcaggcggcattgtccggtatatgttccgcgtctcacgagcggccgttcgcagcgattcctatatcgcaacacctccatattgttcctgttgtttcacccttcccgaatttgtaccactgacatcgcgtcagcgtcacaaatccgggagatgttgctcggcggaggcgtctatatatcacgaatggacgggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttgccgatgtgtccagcggttgtaccgccgggactccggttccagccgattcacccatccgtgaagatatcgtcgatgccgttcgccgcgtgcgcgagacgaccccattggcccagtcgttcaccaattttgtgaccatcaatttggttgccaacgcgcaactggcggccggcggcactgcggccatgagtttcctgccggacgatgtgatcgaaaccgcgaaaatcgcgggcgcgaactacatcaacgtgggcacgctgctgccgttctataaggacgcgctgcccgaaatcgcccagcgactcaactacttggacaagccgtgggtgctcgacccggtggccgccggcatcggccacacccgcaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccgactgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcaaatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggcctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccctgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcagtacatcgttatcagccatgcctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatttccggctccgactcgtccggcggtgccggcatgcaggccgatctgaagaccatgctggcctgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggtgccaatctcatcagtgacgatgccattgcggccttgaccggcaagctgttcccgatggccacggtcgtgactccgaacattcccgaggccgaagtgctgaccgatacgctgattcgcgatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcaaaatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgcagtgagctatctcacaacgattggctcgctacgtggaattcaagacttgggccgcaaacgtcgttcatcccacacaatgggagggcgaacggaacacgcagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggccgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggaccatcccccgctggtcctggcgtccgctgttcgtggccatcggcctagtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggcgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaacgtgttgatgccgatggtggtgggctggatgcttacctcgcttggtaccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgcggtgacatgcagggcgccgttttgttgttctagtaattgtcggtaacggttgaggccggtgccggtggataggcctgcgtctccagcggacaatcagcgtctgtgatgtcacatgcaatgccaggagcggtatcaacggtcgaatcatgcggagtcactgcactgtgcgccgcttctcccctgccttcaatcacatcaatgacttgatgcgtgcggtccaatgcgcctagacatatccgtaaccagcacgtcaggccgcttggtggggctcaggcatcggctgatggccacggcacccaaatcgcaggtccatatcacggcaaaatcgctggacatgcgctcgattagcgtgccgaacactttcagcgcatacgggtcattgtccacaatgccgatgagtatgttgcggttgcgcacttctcccattacattcaccccttcagtgtgcccgacgccgaactgctccgtcctgacatgtcatggtcactatgacaactatcattccacatttcctgcgtgatttatgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcgtgcaatgatgcacgagccgatccaagcaaaggggccgaccatgagcgagacactgatggaacagtgccggttgcgcgaacaacataaacgtcgtaacgcttgtatcgccgccatcgtgacggtagtgcttgtccttgccgtcgccggcggcgtatggtggacggccggcgatggcagcgcattggttcgcaatatgttcaagccgaaggccacgcccgccacgcagccggtagtcaacagcaccgcagccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtacgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctctgccatcgtgctgtgcgcactgatttacggcttcttcgtcatcaagcatgatgatcaggaagtcggcggcgacccgttctacaccgacaagcagctgcgtcagatggaagcggccaaggcctgaaaggacagccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggccgctggcacgtgttctaccagctgcacccctacggcacccagtggggtccgatgcactggggccacgtctcctccaccgacatgctcaactggaagcgcgagcccatcatgttcgcgccgtccttagagcaggagaaggacggcgtgttctccggttccgccgtcatcgacgacaacggagaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcacccttggcgatgacggcgacgtggtcaccgcgccggtcgccgaaatggaaggcctgcgcgaggataccctcgaccatggttcggtcacactcgacatggatggcgagcagatcatcgccgacgacgccgaggccgtggaaatcgaaatgaccatcgacttggctgcctccactgccgagcgtgcgggtctgaagattcacgccactgaggacggtgcctacacctacgtggcttatgacggccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggtttttttgtgcgccctgtcgttcgccttcgcctatactgatggacggcatataacacaatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggttggattcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggccaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggcggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctgtggatgtgcccgatgaggttgtttctgttggcgggtatttggcgggggatgttcatgctcatccggcgttgggtgcttgttctcgtgtgaaccgctctcagtcggtggaccatccccagtcggctatgccgacagctctcgccagcgggggcaaaaggaggtgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacacccccagcaatcaaggaccggcttcgccggactcatcattacctggtcatgtcctatcggcctcggccaggcggcgtgaacgaacagtccactggactgttctttatttcacgccgccaaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcggcttctatcagatgcataaagacgcgggaccaagcccatagcaccagcacggacaccacttggatgaccggccagctccaatacatgacacccggcgtctcggtaggtgcgctaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcatgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccggccaccttttcactggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcttgggtgacgaaaaatcccagcgattggcgtgggctgaacaccatcgggctcaggagaatctggaaggcgatgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccagacgggtttgtcgagcactgcggtcacaaagccggccgaagccataccggaggccacgtcgccaaaggagttgtcacaggtgccgtatccggcaccgtgcatgaacaccacgccggggcgcttgcctgatgcgttctgaggttcccgaatcaataccttgatggcttggacgccgtccgcattggccttgccccgagcaccggactccttggtcagattgccgtcgccggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcagcccatgacggccactcggatcggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcggggccggcctcggtgacgccgaggtgcagcggccaatcgcccttggaggcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggcagcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacagacccagcgcgatgggcagacgcatgtctggcggcgaagcttggcaaatcgtggcgccgtccacaaattcaaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgaggccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcggcttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccaggtatgctgcgggagcaaaggaaaccggctgttccgcattggtgctattggtgcttgtggaagcatcgaacgatgcaggagccggcgcataggagatcggcgccgccgcggccggcgttgcgggagcaaccggagccggagccgtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggagccgcaggctcgccggacacgaaatcggccacacgggcataggattccaagcgactcagcaactgtacgcaggcgttcaggaagtaatcgacctgtcgctcgtcatagcctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcacgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaaaaccgaaattcacgattttgtagcagtactgccggtttccttctgcacgcatctcattgagatttcagaacccttgccgaagactgtcagggaatatcatcacagcctatatccgtggaatgaggggattgcatgaagcgatgaaaaatgaaagtgggcaatgagggactcgaacccccgacatccaccgtgtaaaggtggcgctctaaccaactgagctaattgcccgcaaatgacaacaatagcgtatggccggcactgcgcgacacgtggtgtcgcatacgcgtgccgtagcgctcaatcgcgatgacattcagtcacgcccagcagcactacgcagcacacgacgccagtcaacacgcttaaagtcaagcgtattgattgaggcttatcagcgacccttgccgaatgcgcgcaggcggatgccgttccagtccgagctgacggtcagcggggtggcggcgttcataccggcggtctgtgcggcggactgcacggtggatgagctggtggcacccgggcggccgggcttgggagtcagtatccacagcgggccgtcattgcccagtaccgcgtaggcgtcaacgatcgtatcggacaattcgtcctcatcatcgccgtcacgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcatcagaaacaacgactggccgcgcatgtcaggcctcgcaatgaggcaaatcgtcggcctgccccttgccgatggccaccaacgcctgatacgcctcgtccagcgtggcgaccttgacgtcgcgcagaccatccggcacgcggccggccacatccgaacaattcgacgcgggggccaggaaccatgtggcgccatcgcgcttggagccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgcccagttcgtccgcatgggctttggcatacgccagaccgacggcactggccgaatcctgggaaccggccatgtcttgttcgactttcttctgatactggtccgcgctctggcccaccggtaccgtggcctcacgcggcatgacctccacctgcggattggaccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcggacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaatattgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatccgaagtccagcagatgatggccgcgttcagcgccggcggactcaacacgatgggcgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcgcccggcgatccggatgcgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtatgcctcggtaccgtggctgatgccgcgtttcgaggcgctcatcggcaagtacgcacgcggcatctccattgatctggatgcgatggaggaacagctgcgtgacgccacgtcaatggatccggagtcgatttccggcgcggtgaatctcaccaaggtcggcatccccgacactcccgaacagcgcgaggcgctggcttcgctggaatcgctgctggctatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggctatgggagatgatcaccgccgccgaaggccctgaaggccgtgacgccaagtggtcgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgacgttcaggagcattcagtatgcattacagacgcccgtcacaaaaatcgtgatgggcgtctgcgctgcactccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcggaccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaagcaccggcaaacgagtagatggtctgggccggatcgcccacgacgcatacgttgcggttcattgcgctcttgccgtcaggtcctcccccgcccagccacagggtcagtagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccgaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcgggctcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgattcaagatgcctcaggcaagttgtacgacgtatacgccactgacaccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagactcaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgacatcgtggccgctggcgacgtggatcttaccccggaagtcgaacccgatgctgaccggaccgccaatcacccgcaaacgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtgcggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacgcgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcccgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgccaccctccttgacttgggcgagcacggattgccaggtaatcggataatcacgagacaacaattcgaccatgcgctgcgtgcgttgcaaccgtgcggctcgagtattggcgaacaagtccgtgatgtgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcgacagtggcgttgggggcctcgctcattctgtccgctgagactttgcaattggctcggcatccggagtccgcgctcggctgcgatctgaactcggcggtgtcctgttcggcggtggcccagtcctggcaggcggaaatcgtgaaattcggcgggctgagctatccgaacgcgttcttcggcatcgccgccgaatcggtgttcgttaccatcgcggtgatcggtctggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcacgtaaagctgtggcggctgatgatagcgacggtgaggctgaggtcgcaatggtgccggccggactcaataagtattaccgcctcaacatcgacctcatggtcgatatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtaccgccacgtacggtgatgtcccagtggctgatgccggtcttggcccgcagcacaatgcctgtggcgcacaggccggtgccgcaggacagggtttcgccgcagccacgttcgttgacgcgcatcgtggcttcacccacgccggtgttctggtcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacaaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccaccccctcacgctgagcgaacaaggtgatggcgcgtgtaccgttgccgcacatctccgccaacgatccatccgcattgcgatagtccatgaaccatttcgcgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccgcaaaacaatcggctttgtgatcggtcgcggcaacatacggttgcaggcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggcgtgccgtatttcgatggcggcatcgctgatccggtgccggtgcagaaggcgctggaggacggctacgatcgcgtgattctgattctgtcccgcttgcgtaacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcggaaggcaaagtgctgatcctcgcacccgaagacctgtatggtctcaacaccctgaagaagaatttcgagggcctggaaatgatgtatcgcaagggatacgcggcggccgaagccattccggcattccttcaggcatagcgatagtgaagtccctcgcttggagggacttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgggcaaaggcatcgtccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacgttgtcgagcgtcttggtttccagctgcacgttaagctggttgacgcgcatgttcgttttcatggcgatgcggtccacaaacggaatgcggatatggatgccggcgaactgcaccttaaggaacttgccgaagcgttcgatgatgtacgcctgctgctgcggcacgacgaagagtgcggcagacagcagaacaatgagtagcacgatgataatcagcggaccagcaaagaatacggccatgatgttttcccttcacccacgtcgaaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgccctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgcccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcccagccctctttcagcacctcggccgcaatattacgctgcctcaaataattcaaagccgcgtcaatccgtaccggttcatcatcgaaaatggccacgatgccctctaccggagtatccgcgacgatgtcgatatctccaaagattatgttgacatcgatgccgaaccctttagtaatttgcgacaccaacgcttcagaaacttccttggacacatattgcatccggaccaatcgttggccttcagacaatctcatcaaaagggagtcatggttctcttttcatatctggcgataacgcatatcaaatcagcaatcagcacaaagacgctcggtcactccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcaccgtggcacgcggaaccggcggcgccgaacttgcccacaccccccaaggaaatcactctgctcgatatccatcaggcagtggaagccacgaacctcgatgatgtgatcggcatccacgagagagggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagcccccctactctctgatccacataaacagataaggcgtgcgccatcaagaccgatcgatgacgcacgccttatgcagctcagaccacggattcctagtcagccagcagccccagctcctgcagcttgttcttgatatccactgcagagggttccacttggaacgagccgtcatcgtaccgcaccaccggaatgtgcatctggccgctgatcgccacggcacggtcggcggcacctccctcttcctcgatgttgtgccaagtgtatgccgcgcccagtttgtcgagagtgttctttgcctggcggcagtcgccacaccatgtggcaccgtagacgtcgatggtcatatcgggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaagcggctccggtgtggcacaaccgacgccgctccccaggagtagaaaaataggcagaaaagaattagatcaggcaaacaccccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggttcgccagatcctcaccggaaacgaccaccagaccggcgttcacatcagaatgaccggccagatacttggttgcggagtgaatcaccacatcggcacccaaagcaagcggcttctgcagatacggggtcacgaacgtgttattcacaatcgaaagcgccccgaaacggtgggccaccgtggagatggcgtgcacgtcgttcaccttgagtagaggattggtcagggtttcaaagtagacggcttgggcaggcgcgatgccgttcgcacggtcgcccttgacggcggcctccaatgctgcgatgtcctgagtgtcgacggcctcgacgatgattccccagcgagtgaagaactcattgagctgggaatacgatccgccataaatattgtcaccgaccacgatgcggtcgccgggcttgaaaatgctcagcaccgcgtgaatcgccgcgagaccggaggcgaacgcaaaaccacgcgttccctgctcgagctgggcgatctgctgttccaggaagtcacgtgtgggattgccgctgcgcgcatagtcgtaacggggcatcgcgtcgaccctctcgaaagcatatgtcgttgagttgtagatcggcgggttcacagctccccggtgttattatcgtcaaccggcagtccgtggacgagctgagtattgaatctggtcattgcgcacccccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccgaccttgaagcccttgttggacttggcccaggcgagcacctcggtgttgtcggtggagaaggcgtcaccacggccgtccagcaacgcgttgtaggcatcggcgtactggtcgtacttctgcagcttgacgttcggcgcgttcttctcgaaccaggtttcggcggtggtgcccttggcgatgatcagggtcttgccgtcgagctggctgacatcggtgatctgggcgctctccggggagaccacaccaagcgccaccttcatgtacggcttggcgaagtcgactttctccttgcgctcatcggtgacggtgaagttggcgagcaccagatcgaccttgttggaggtgagcacgtccacacgggcggccgggtcgaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcgttggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgtgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacggcaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgatcgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccaatcggcgggccacaatggacagcggccagcacacgatgaagtacataaagaaaatcacgccataaatccacaaggttccagtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcgccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccaccaacaggccgaccgggatggacgcgcctacggatacgccggctatccacacggtgacccacaggccttgcaacagacgtgggaatacgcccggctggagcagtatttcagcgccgctcataatcgaacctccgctccaaccatgtaccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctgagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggtcttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtctacgtgggcgaattcagggaccttataccatttgacggggtagccggcaccgtgggcgcagaagaccgagtcgggggtgttgtccagatctgcttcgggatcgtaagcggcggctgcgatgatctgttcggcgtcatggcatggcttgtagccgccgaaagtggcggagaaacggccatggccgtgcgtgtactggttcacgtccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccgataccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccagccgttccacccacaccacatgcaacaacgggtcttcgtcttccagctcacgcaatgcggtgatgaccttatgcaaggtcagatcatcgaactggggacgggccggcgagctattgtccgccgcggtctggcgagcggtgtcgttctcctcattgcggccggttcccgacttggcggcatcatgctcggcatcgtcctgattcacgctgttatggccggcgccaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggtatctcggtgaccgtctcgaatttggcgccattgtagacgcgcacctgatcgactttctcggaccataccgtgccatcatccccctgtaccggcgacggtgctgtcgacgccgcggcgcacgaggatgaagagacgatctccttggctttgagcgcaccgccggtgacgcgcagccacgtcatacggttgtgctggccgtcgtgggcgattttgaacacgcgtgcggcgaaggcggccggccattcacgttcgcgggtgaacgtctccagcccgtccaggaattcctcgactccttcgagtttcaatgccgagccgaaatatacggggaacagctcgcgcacggcgatcatcgatcgcaatctgtccacggacagcgcgccatgttccagatagtcgttcatcgcctcctcgtccagggtggcgatatcctcggcaagcgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccacagtgtctcggtatggccttgcacgccatccgtgccggagaccacaagaatcgcgtaatcaagcacacgcagcacccgttcggtttcggctgcgaagtccacgtgccccggcgtatccagcagggtcagtcgcaggtcgccgtgttcaaccaacgcttggtgcgcgaagatcgtgatgcctcgcgccttctccaaggaattggtgtccagaaacgcatcgccgtgatctactcgccccaatttgcggatctcaccggtacggtagagcagcgcctcggacagcgtggtcttgcccgcgtccacatgcgccacgatgcctgccactatctgtttcatcagctgtgctcccttcccgatgcgccgcgcaattgccggccgcctaaccaatatatccgagaaaaaccgggagggaataattttaccgtcagaccgggatgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgacctcgatccgattgacgaggtgcttccccgattcatcgcatggctcgctaccccggctgccggtcccgccgtcgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattatgtcaccgagcatcacgaatccgaagcgatccgctggaagcaggcgccggccaaaaacagcgccgaaatcctccaccagcagttggtggtaaagcggtagtttacagcccgtattccttggcgatgacggaccagaggtcggcagcggcctgatcaacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttgagcaatgtaccgtagtgggccatgccgtgcaccacggcggtttccaggaactcaccggccgcttcgcgggccaggaactcgtcttcagtaaggaaccaatagttgacgccatcaacctcgccggggcgcggggcacgcgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaatgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgataatcagaccaaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttaaccgcgacctgctggccggggtggatgtcgccgccgtcgcccttaggcagcagcagaccgttggcacgctgatcggcgatggtttcgccggccatgatgcgggcagcagccttggccagtgccacgccggtggccttggaggcgaacggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcgccggagtggacaccggcctcctcgacgtgctccataatgccgccgatgtatagttcctcgccgtcgaacagtgcgtcgacatcgatttcgatggcgtcttgcaggaacttgtcgatgagcagcggggagggcaggcgaccggagaccacggtatcggccttggcctcggcaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagtacttcgccgaacagctcacggttctcggccaagtcgatggattccggggtggtgccgagaatcggcacgccggcagccttcagacgcgcggccagggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcctcggggtgagggtttcggcctcgcgcaccgtcatggcggtctcattgatgaggaagatctgcttcaggaaccacgggtcgatcttggtggccgcgaacacctgctccagcgtggcaccgccccagatggcgcgcatgagctgcaggtaacggtgttcggtcggggtgtggatggcctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagggccagcttggtggcgatcttggcgatcgggaagccggtggccttggaggccagtgcggaggaacgggagacgcgcgggttcatctcgatgacgatgatgcggccggtgtccggatgaacagcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccaaccctcgatgccctcttcgatcaggacttcgtcggtgggcgagtaatggatgccggcgccggcgatgcggtgcagctcctcctcgttgtgggcgatgccggagcccaggccgcccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttctccaggacgccggcctcgcccagcgccatggcggcgttgagtgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccgggccgttggagaagaagacgccgtccgggttcaggttctcgatttcggcgaaggtgatggtggagggcaccacgtgcacgcggcagccgcgttcggccatgcggtgcggggtcatgcccttgatgccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcttggtatccggtcataccggtggcgaagacgatctcaccggtcgtctcgccaagggcgccgtatggcttccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttgggcgcaaagtctcaccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcatcggaatcggacgattcctcatcggcctcttctgccacggactccggtgccggtgctgcgttcttggcggtgcacactgcagacagcaggccatggatgaaagcgggcgaatcgtcatcgcacagggtcttggccaatgccagagcctcgtcgatggcgaccttgtccggcacatcatcgttgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctgacttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggcaccggtctcaacggtggccggcttggtgccggcgttggaacggttgccctgcaggcccggctcggtgtgggtgatggtcaggaccacggagcccggcagatcgacgctcagcggggtgccgtcgtggaaggagactaggcagtcagtgccttcgagcaagaacttggccttgtcgcccacgagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccacgtgaccccccgactagactggatgaatatgcgatccttcttcgaagccatatccgtgtcctgcgtcgtccccgcgcaaccgcaggcaggcggcgaacgcactgtgttcgagaacctgtcctttgccgtggagcgcggcgagatcgtcgatctggtgggaccgtccggctccggcaagtcgagtctgttgaccgcgtgcgcccggctcaacccgcatgcgtacggcacgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcagcaagggcggcaaggccgagcagctgctgcccgacgagcgcatccgcacgacgttggacgcgatgggctgcgaggacatcgatctggagcgcgccccgcacgacctgtccggcggccagacggcccgcgtggccctggcccgcacactgctcaccgatccgaaggtgctgctggccgacgaggtagctgccggtctcgacgacgacaacgcagccaaggtggctacgatcatggcggatgccgccacacgcggcatggcgatcatccgcatccgccaccgtccgccggacggacgggccacccgcacgctgacgctggacaaggggcggctgaccgaacgcgagatgacggattcggcggcgcaggacgcgaacgcggtgcctgacggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcgtcgtgccgcgcattggtgcagctgtgcgccatgggcttcatcatcggctacgtgatccggtcgaacaacgtgtggatggtgttctccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccgtgggagtcggcccgcccgtccatcgtctcgtcgattcgcttgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcctgaagcgcgctaatcagctaagctccctctgataagctccctctgacgagggagctgtcgagcgcaacgagactgagggagagaccaccctacgcgatggtgaccagcgtgccgtccggcacctggtcatagaaccattgcgcgtcggccacggccaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcaccgcgcgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggccccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggttgcggtgtcggctcgcggccagctgcgctgcgccgccgcggtctcgactccggcgccgatcaggcagaacaggatacagcaggcgaccactccgcgccgaatcacgtagacccgatcgcgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgatcatggtcaccgcaccaagcccgatgccgaacagtcccgaggattgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgtgggaaggggaagatgatgctgccgtccgactgtgtggggtattcctcgcggacttgggcgaacacttcggcctcgaacttcttgcgcccggcgtcgtcaagcgcttgcagatacggcctcatgccggtgccacgataccagtccataatcgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcgggcgatgagcccgtcaatcgcggcctcgccttcgatgacggtgaaggtcagggacttgcgttcgctggcctgcggggcgatggcgtgcaggtcgccgcgctgctcgtgccagcctcggccgtggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgtcgcgggtttcgatgatgcgcttgccgtcctcgccctgccaggagaagaagccctggccggttttggcgccgagattgccttccctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcgcgcagcacggccagttgcaggcggttgcccacaaagcccagcgattccttcttgatcttcgccggcttcttgccgatcttggccatgaggtcgaaggtgatgtccaccaccttcggatcggtcttctcacccggcaccacttcgaccagcggcatcaactgcgcggggttccagaagtgcgccaccacgaagcgttcgggcttcttcagcaccgactgcagcgcggtggggctcaggccggaggtgttcgtggacagaatcgcgtccttgggggcggcgtgctccacttcggcccagacggacttcttgatgtcaaggttctcggccacggattcgatgacgaagtccacgtccgccacgccgctcgcatagtcggcgtaaccggtgatgcgggccagcaccgcgtccaaggtgtcgccgtccttgagtagtccggcttcggcgaagtcctcggcatccgaacgaatcgccttcatcgccttctccagcgaggcctcgccgcggccgaccagatgcaccggatatccggccaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgttcgcattctatgccgatttcgctacgtgaacatttgctgaacatttcgcggattcgactagtacaaatccccatatcagcacaaaagcgtggtgccgcaacaccgaagtgttccagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaactccacgaacatggaacgcatgaccggagtaccgttcacatgaggctgcaggccaagctggtagacatacggcatgagttcaagcttgagcttggtgaactcgcgcaccacatccacggcggtctggccgggcaccaatgcgacgccgttcttctcgtcctcctcgtcgaacagccacggcacacggtacacggtggaaccgtgcagtcgcgagtgggagccgagcatgccgaatgccacccaacgcttgtagacggccggatccgggaacgcaccttcgaagccaccgatgtcgtgactccagaagccgaagccggaggaggtcagcgacaggccggcacgcaaggactgggccatgccattgaaggtggactcgcagtcaccgccccaatgcacgggctgctgctggccgccgacggtggcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatacgctcgccgaaatcggtcttgatggcgtccgcgccctgattcagcaacgccttgaccttgtccttgaaccattcacgggcggccgggttggtgaagtccaccaagcccatgccggcctgccagaagtcggtctgccagacttcgccattgggcttgcgcaccagatagcccttgtctcggccctccttgaacatttcgccgcgctggccgatatacgggttgatccaagcgcagatgtgcaggcccttgtcctcgtgcaggcgcttcagcgtggattcgatgtcgccgaagaaacgcttgtcccactcgaaatcgcaccaatggaactcgcgcatccagtagcagtcgtagtggaaggcggccagcggaatatcacgctcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccgacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgcattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagccccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcatgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgccgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccacccccttccccaccgtcgacatcgacaaccgtctcgcttcacgcaagctcaccgaacatatgttggggcgcgggtatcggcgaatcgcctatatcatcggaccgtcgtacttgccgacgccgacgccagcgtgcccgcagctgaccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgtcctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccggcagtgcgctccattgcctcgaccaccaggtcgcgggtgctgtggtcaagcgattcgcccaccagcagcgaaccggacttaaacgccagcgccgcctacaaaagtgtgaggctgcgcaggctcacactgccaacagccgttcagccaaccctcggaaggtctggccaatgccatccgtacgcaaagcgccgtcggcgtccagcaccgccggacggccggcctcgccggtctcgcgcacttcgggttccagcggcagctgggccatcagcggcacgtcatagcccagcgcctgagtgagctgttcagacacgcgctgcccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagcgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgccacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagcccccctcatcagagggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaacgaaccggtgaccaccacggttttgccggccagcgtctgcggcaacgaactggtctcggcctcgtcgacgcccacgccggcggcctgccaagcacgcaaagtcgcgccgcgccagtcgccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggagcctcagccccggtaggtgcgccggtcgtctcgctggcggtatctccctgtgtttcggcagattcgattgcggcctccccttgcgcgcgttcggccagctgcttggccgtgagctttttggccggcgtgggcgcggtccagaaggcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtccccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgcttgacttcaaatccattgtgcagcgtggtacgagccacggtggagccggccacgtagacaggtttgagcacggcgaccggcgtcacacggccagtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggttggcgggaatggagccgatggttcgcacattcagggtgatgtcttcgcctgtaacgccgtcgccgcgcgtcagtccctgttcaagcacgccgttgcgatagatgaggttcagggcgaggccgtcgattttgacctcgcagctcatgggcaggggcttggattcgggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtaggcgactgcggattgtccagtgaggggaacgccgcttcgagtcgttcgaggcaacgcatgcgcgcgtcgtaggcggcgtcggagctgacgggtgagtcgtcgatgtagtaggcgatctgatcggattccacccatgcggccacgcgagcccacaggcgggcggcggcctcagcggtcatcatgttcacgtcgaaacggtcgaggcgtatcgcgtcgtcgtcagtgggctgcagtgcggctatccattgttcggagccagggacaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacggccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcgagcatccattcggcgtacgcgaaccggtagtaggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttaagatgcgggatcgccgcctcggcacccttgatctgactcaacacgtcagccagctccatgtgcgcgtagaacagattgtccgggataagcaccgtacgctcgtccaatgtggcgaacagccggttgtagaccacgcgctcggcataggagttgaagtatcgaggtacgccatggcctgccgcatacacctggtccaaatgggccacggccgcttcggccgcttcgatggcctgatcggcttggcccgagaacagcatatctcgggcacgcagacgctccttgtcaagatcgtcggcaagcgtgaacgtgaagtccggtgtgtccttgccatcgatcaacgcactggtgacctgagaggccaagccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccgggctgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccgacggccccatcagcaccgtcagtgccgacgcccccgccgccgataccgcccaggtcgtcgcctgcgccggtatcgtccggcatgccgaacgccatttcgtcgatatcgacgcccttcatcaggtcttcgaactgcgaatcgatggacgcggcgccatcggcgtcagcggattcgtccgcggcctgatccgtagcatccgcagacggtccggtaccgttgccggttcccccggccgtgccgcgttcgtcaccggacgccgtctgtccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcggcgctcatcgacgcgcgttcggcgctgctcagcgcacgccacgtacgtcgagtgctgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgaccaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagagcgccggcttcgcgcatcagatcggcgaaatgatcctccagaccggaggcccgcatgccgtgggcacgtgccgccaaagtgtcacgcaccgaacgtcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgccccaaaccacgcccatgatgcagcgcacttcccaagccacggcctgcacaggagaaaccggaacgtgaacgcggctcgtcgctttcgcccagccgctcaccgtccggcaaagtcacttctttttccttgccgaacatgaatcgcgcctgcatatcctgcacgtccatgtcggggtcggtgcccacgaatacgcggccatgcgtatcggcgaacgccacctgcgcaaaatgatcgcggtcggggaaaatgccaagcgagaagccgcggcctctggtggagggcagctgcgcccatccaagcaccagcccttccggcacgttctccaattcggggaaggtgcgtcgcttgattacagggctcagcgccactgcatggcgagtcagttcgtcgataatgccgcctttacgctcactggtctcctgcaaggcatcgccgaacggattcgtatcgtgcttcttcggcttggacagtcccagatcggccgcgagcgcgttcatcgaatccttcagtccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagactgtccgatgccgtcgaatcatgaacggcgcctgcccagccgtccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgcgagcagcaaggtcatcgataaggcccgtgagcaggccgaggccgaatccgaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttccagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacctcaaggcacagtacaagatggtgctcagttcgggatacatctaccgcgtctaccagtacggcttccgcggcttctacttcgcgtgaggattggcatcgacctcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccgggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgatgacgtccagtcgacgctgtgcctcggcaacgtcctcggcaggtccggacacctgaatccacccgactttggcgtgcggcgcggccagcattttggagaatccgtctagggcgaaggtgagcacgccgcgctcccccgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgacacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacaccaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctttgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcgggagatgagcatcacgcgttcaatgacatgggcatcgccaagctgcacttccagatcggtgccggccaaggccagtgggcttggggcgacggtggcctgttcattcataagtaacctgtagtgacccccctcatagaggggagccactactacggctacttcagcgacggcatgggcttccaggtggggtcgtgcatcagcttgcgcgagtcccaccagcccttggcaatctgcaccaaaccggtcttgaggtgctcgcgatccaccatcaccaggcggatgacttccttggccacggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcggaatgcccagcggcacaatgaagtcgtactgccagtagaacgggccgccatcgtaatcgaatcgggatccctgaatcacctcgtgcttgtcggtccacttggccagcttggcaatggcgtccggcagcacggccacatcgtcgtccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcgctggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgccgcatacgctcaacccgccgccggaagctacggccagcagcaaccgcaatacggccagcccgccggcgcatacgctcagcctcagtacggccagccgcagtacggccagccgcagtacggccagcccgcacagcccgcagcgggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgatcaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatccttttctacagagaaggtaacatgttgttcaattcatatgtgaatcgaacaatgccagtacttccctaggtgcttgcttggggaacgccatgctgaaaggaacacattatggcggagggaaaagtcatcatcgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccgcattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattaatcacgatggctgtggatttcagacgacccagacgatccgcattcagcagatgatgggtctgcggcgagcgcggcaccgccatcgccaccacgtctgccaatggcaacagcgtctccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggttgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgagcggcctgcgagaccgggaagttgccgatgactgcggtagcttgggaacgaagctcctcgggaacagcggccgaccataccatgtcgccgcggtgcgcttcgacgcccacgaattcctgcggcacatcgcgagccgccttggcgaaagcccgccgttctccttcgttgagaggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcatcctggagcagtctcctcgttcgaaaatcggccgattgatgggcgtaggatcgctggtcattaccgtggctccggccatcggcccgaccgtcggcggcgcggtgaccacagtgctgccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgttggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttacgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgcaacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgccccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcagtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccaccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcaaagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttggcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcgcccgggtagagagtcaaatcaacaccatccaaggccttgacgcccgggaattcaatcgtaatgcctttcattacgacgatggggtttttatctgtcatgtctttgccttaaacgagaatgaagtgttatcgttttgtgatatttgagccacacatgagtgatggtgtggaaggaacatccttctcacaccatcacatcaattatttggttcagttatcaatgagtcgcagcagacttatcagtaggcgcgggtgttgttgtccagagcttccttggcggaggcggcgtcgaaggtcttggactcgatctcgatgtccttctcaacggtcttgccatccaggtagtccttgacggcctgagcggtttccttgccgaaaatcgggttgtactcgatcacgtaggagaggtcaccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgccccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgccttctgaatgtccttctcgttggcggtacggaagccgccctcaggaccgacagccacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttattttttggatgatctttcatcctgtttggtgactgttcgtcatcgacagcctctagtatgacgctcacaggccaaatgttcaatcgcatgcgataacagtttgataacaggtttataacaaattaataacagtggttcaaaaatggcgtcgcaacactgttttgccttgataacagaccaataatagtgattggttgcgcagcggcaatgccgctcgccagccgagcgacaaagccgttgcctcatacaacaagaaaggttattatgaacaccgtttttcttataccatctactgcgcaccgagggcagtgacctggctatcggcgatggtccaggaaccgtcgagtgagccagaaacggagcgaacaatacccaaatcgtccacaatggccaggcgacgggacaggctaatctgccccgatgccatcgacgttatggttccattaggcagacgctgcgcattggccgggcctggtgccatttgacgccatgcctcttgttgttcgctgtttccctcaggaggtgtggtggcgtacaccagattcagatcattgtagaacgtgagcatggtgacgtgtctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcgccaagccaatcaagcttcagatcggtttccttacccccatctgacacatgcaattcgcgcccgttctcggatacagcccatacttcgccatccagaccttcggtaatcgatcgcatcgactcgccggagaacatcaccccacaggacgcaccatcagatttcaggcattcgacgacaccgtccgcacgcaacaccgcaccgccggatgaggaaaaaacgaagccccgagcatcgtcatatccgggggcctcccctacacgcaacggactggagctggccagggaaacgatatgcccaccggtcaacgtgtatacgcccgctgtcggctgctcggtagtaagtttcacatttgcgtcggcatcagaatagtccactccgtcgccggtaatcttcagcgcgtattcggcattgccgtcgcccatagtcagacggatgcgatgtaccagcaggcctcgttcttcctcattcaacgcattgataccgctgttaaggtgtatctccaccacattgttcttcaccggcacgctgtcgaccgcgagtttgatggtaggcaagccggtgcctcgcagcactccttccaaccaggagggtgcatccgagagcacttcaccgactgcctgggtgcgccagttgcgccagctcagccatcgaacatccggtatgagctgtttgccggatgtgctcacctgatacacggatacttggcggaagacttgttcaaaatcggcggtggatatcaccacgccgttctccaacgaggagatgcgccactggccgcttcttttaatcaagatataaggaactttgctgatcgtgctgctatctgtcggcgtatacacgccatgcgagtccagagagccgaccacttggagctgtacttctacaatcagcgagctctccgccccttgcggggtactcatcgtattggcacggcggcggaaatccggggtgccgctgtataccagtgccgcagaatctccattccacccggcagaagccgagccagtcaggaattcgcgagccacgcgatagccatcggactgcacgccagcaggcatagcgtcatagaaccctttgacaatggtttccggctgtgcatcgtccgcaggcccctgaggattggtgtaaacacgctgagtctgctgttccaccggtgccagagtctgcaccgagccgctaatcggcaaaccgaacggacttgagcatgccgtcatcgtgacgcaacagactatggccgcgcctgcggcggcaatcgttctggtcactcgtctcatagcggcctccccatcatcgtgtcgcggcgaacctcatgataatcatgtgtgacttggctggtggccacaccaaacccaccggtaatacgcaggtcatcgggcgtttcagaagcaaaattcaccggcagttcagcgtccgccacctcaccttggtcggggtcacgcggcagcaataccaagaaccaggtgccctcccccactgccgaacgtacacggatagtaccgtggtgcagcaaggcatcagtcatggcgatggccaagcccaatccggtgccgccggtaacgcgcgaacgtgaagggtcgcttctccagaatcgatcgaatacatgagcgactttgtcttcgtcgataccaacgccatagtcgcgaacgctgatggccacggctttgcggttggccgcgacacgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccggcaacttggtccactgccgtttcaattggttcgcataaatcggtttccacaaggtcaagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggggtacgcaattcatgactgacgtcggacacaaatcgtttctggaaaacgcttgcttcctccagctcatcaatcttctggttgagcgcatcagccatcgtattgaaggattgctgcagcacaccaagctcatccttacgatccacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccgacatgccggaatcaccgggaatttcgaccggctgatagaacacgctgtcatccaagtcggaggccacggacgaacggatgtcatcagaaatcagactttgatagctgggttcggtggatacggggatgatggcacgcgagttggtatcacgactccacaaatacacacctatcaggttggagggcccctcggattgcaacgaggacgccaagtcattgaccagctgctggatctgcactgtggcggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagtgtaagaatcacggtgagggccacggtgcgggcctgcagcgagcgacgaacttcaacgcgtccgtggcgcagcaagcgtttgaggctgaatcgagggcgcaggttcattgttcaggagtgacgaacttgtagccgatgccacgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtaagattcaggtccttgccatccttggtggcggtgtgttccaaacggtcgatgacgatggatccgcgttccagatggttgacgtttgcattgccaccgcttgcgccaccggtggcaccgtcttcggcggccggcttggcgatgcggaagcgtgcatggatacgcgccagcaattcggccactttgaagggcttgggcacgtagtcgtcggccccggcttccaagccggccacgacgtcaagtgtgtctgatttggcggtgagcatgataatcggcacattagaggtagctctgatgcggcgggccacccccgtgccgtccagcccggggagcataacgtcaagcagaatcaaatcgggcttgacgatggggaacatttccacagccctcagcccgtccaggcaggtcacggtctggaatccctcgttttccaaaacaagactaagcatttcgccgatggcctgatcgtcgtccacgatgaagatggtcgccatggtgtttgtcttccctttcccactgttattgttgcgttacactttactcccctatgttcatttctgttcgggttccccgccatgcaacatcgggcgaatcttggcaagacgctggctgacttcgtgttcgtagccgcgatcgttgggatggtagtactcggtgccacgcagctcttcgggcatatattcctgtggcgccacggcaccgggccaatcgtgcgcatacttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtagcttcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagatagtggatggcggcatccggatcggagccccgcatggatttgatgaatgcggaaatcacgtcgtaatggtcatcgccgtctttgtcgtagcgcacggtggcggtgtccattaccgtagccacgatttcgggggtgatgatgggtcggcgtgcgccctttttgcgggcttcgtcgccagtgaccgcgccagccgcggcctccagaatcgtgagactcttgcgtgcgtcaccaccggccatgcgcacgatgtcggcgatggcttcgtccgtggctttgacctcgcccctgagaccgcggtcatcagtcagcgcgcgctgcaccagttcgatgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgtacctcgtcgatgaacagtacggtttcctggccgcgtgacacgagccgttcgtgagcgcgggtgagtacgtcgcgcacgtctttgacgccggatgtcacggcggagagttcctcaaacacgcggccggattggccggccacgatggtggcgagcgtggttttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgcgtcatcgactccggcgcatcagccgccccaaacaaatcgttctcactcataacgtcctatagtaccccagtgttcgaacagacgttcgagctgcaccctggcttccctcagagaggggagccaagaaaggaatcagttactcaccttgtagtcgtggaagactacttcgccggtgtcttgggtggcgtcgaggtccacgatgccttcgatggcccaatcgtgatcgccatcggaatcatcgataatctgacgcaccttccacgtatgctcgtcgttctcgtgcttgtcatccaacatgaacagttcgggcgagcgcgcttcggcgccgatgcccacgtactcgtgctcgtcgtagtagtcgtcgagcacatcttcccattcgtgcacaccgtagccccagtctttgtcgagcgcgccgagcttgtccggctggtcgaggtccataagctgcacacggcggaacatggcgtttctgatcagcacgataaggcctcgtcggtcctcgaccaccgcgttcttcttgcccggcgccgccaaggaggccgccgcctcggactggtcggcggaatcgccggcgttctcccattcatccaccagcgaggagtcgatggagcgcacgagcacgcgcagccaggagatgatgtcttcgagttgctcgtcacgcttttcgggcggcacggtacgcgccagcgtgcggtaggcgtccgagaggtagcgcaacagggtaccttcggagcgggcgatgttgtatcgggtgatgtatccggtgaagtcggaggcggtttccaccatgtcgcgcaccacggatttcggcgatagccagtagtcgttggcccacggcacatcgtggcggtactggtcgaacgcggcttcgagcatgtcttccagtggcttcggatacgtaatctcctgcagcttatccatacgctcgtcatagtcgagtccgtcggccttcatatcggccatcgccttgtctcgggcctgacgctcctgggcacgcagcacctgcttggggtcttcgagcgtggcctcggccatggaaatcacgtccagcgcataggtgtcggactcggggtcgagcagttcgagcgcggccagcaggaacggggagagcggctggtcgagggcgaagtcgtccggcatatcaagggtcatgtagtagtccttgccgccgtccttgcggtcctcggtttcgatgacttcggtatcgaacagggtttggaagatctcgtcggcccgctggtgcagatgctccttttggtcgggggtctgcgcggaatcgtcgatgagatcgtcgatacgggcacgggcgtcgccgccctgcgccacttcgttgagcaccatcgaatgcgtgattttcaggtgcgggaccagggtttccggttcggcgtcgatgagcttgtcaaacgtgctctggttccaggtcacaaaaccttccggcgccttcttgcgcttgaccttcttgagcttcttcgggtctcccccggccttggcgatggctttctggttttcgatttcgtattcgggagcctcggcgatcaccagtccctcggtatcgaatcccatacggccagctcgtccggcaatctggtggaattcgcgggcgcgcaggcggcgcatcttggtaccgtcgaacttggtcagggccgtgagcaccacggagtgaatcggcacattgatgccgacgcccaatgtatcggtgccgcaaatcaccggcagcagaccctgctgggcgagctgttcgaccaggcggcggtagcgaggcagcatgccggcatgatggatgccgacaccggtgcgcagcagtcgctgcagaatcttgccgaaggctgtggtgaacttgacgcctttgatggcttctgcgatggcttggcgctgttccttgctggatacaccggtggaggcgagcgcttgcgcggtctccaatgcggcgtcctgcgaaaagtggaccacgtaaatcggggtttcgccgttgcggaaggcgagttccacggttttttccatcggatcgagcgtgtattcgtagcttaacggcaccggtcgcggcgcgtcggcgattacatccacgtccggggtgtcgttcagatcggagagcttgtcggcaatggcgtccacattgccgagcgtggcgctcatcagcaggaactgggtctgcggcagcgtgagcagtggcacctgccacgcccaaccgcgctccggatcaccgtaataatggaattcgtccatcgccacgaggcccacgtcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccgagcgccaccagcgatttgcccgaaccggtcggggtattcaaaatcacatggtcgccggccaagaggtccataatggcctcttcctgatgcggccacggctcgatgcccttgacgtcttccacccagccgaagaatcgttcgtagatgtcatcggccgtaagattccgttcacgctcgtcaccgtcccattcgggggccagccgccccagggatccgtattccttctcgtcagtcataatgctcagtctacccagtggcctattccggcggcacgagccaccctccgtcgctatgcgacgcctcccgccagcgggcggagccgtgcgaagagccgtgccatgcgcttggctccgccagtgggaggatcgctcacgccaaccggcggcgcacctcgtcggggtccacctcgggttcgaggggcggccaggtcatgttcatgttcttcaaggtggtgcgcagcagttcggagaccactgctcgcgaataccagcggttatcggccggtacgaggtaccaaggtgcggcggccgtgctggttttctcgaacacctcctgccatgcggccatatactcatcccagcggtcgcgggcctcgagatcggagatgtcgaatttccagaacttggtgggatcgtccagtctcccgaggaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggaacggtcgaatacggcaatccaccccgccttgggcacttcacgcttcacgcgccagaggaagtcgtggtcgagctcctcggccgcaggcttgccgaagccatggtaatggatgcccatcgggtcaccttggctgaacacgtgacgcacgatgccgcccttgccggaggcatccatgccttgcagcacgatgagcagccgccgtgtcgagcctttgacgccattcgcgtacatgagccgctggtatcgggcgatttcggaggagctgatcgaaatgaactcctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgtgccagtcgttcaggcacgctggcactggagtcgatggtgtctatgcgatccgccgcgagctgtaataccttgtcgatccgtcgatcggttttgtattcctttcccttgccgttcttgttgttctttcctgaggattttccggctgtaccccacttgccggcctcttcaggcttgttggttctgtcgtcgtccttggccatgctcccgattgtacgtcttgtaactcaggagacccagcaacgtagcgacattcacattccacttgttactgcaaatctatagacatgcagtcgttcggaccgtaattgttggctttgcaccaattccaagcctcatccgtcgagtcgaagccctcaccggcaagaatcacatagtatttgtcggaattgctgctgtaggtgggccagtcacccgaccagataagcagtacgtttgacttcttgttgtgcatcgtgatgaattgcgcaagaatatcgtgatagttccaggtcttgccttcagcttccatgcccttgcgcttgctggacagctgcgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattgtcgctctcgctcttgatcgaggagactttcatatcggcagcggcatcgcaggttttggcaggctttgccttgtcggggtcgatgtatgccaccagatatccgccggctttgatgacggtgtccgtattcgttacttcgctggtgccgatggtgtagtgcttcttggctttcttgtcactgccgtagatgcccagaccttcacgtcaacgtctgtggagccggtgttcttgagctcgacccaatcgcaacgcttgctatccgggtctccggcagctttcgtattgccggcatagacctcgttgatgattacggatggtttggcagccgtgttctgttcggcagtggtctgctgctcgtccgcagtcgcagcgggcacgccgatcagggcgatgctgctcagtgtcaccgcagcggtgagcagcgcgactgaactttggctgaattactgctgaagctagttcttggatttgcgtcgaaccgtccgtattccgccgacaatcgcgattacagcggtaccgatagctacgctgatcaacgccggtcgttgcgcggcatggagggtggcgagatccggtccggccgcaatggcactgttttcacccgccgagctatccgacgccgggtgattgcccgcgtcggtgtactgggcattgaccacactcgggccggtaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcagtggctttcaaaatcgcgttgcgctgatcggcgtgcagttcgggataggccagtcgcagcacgtccgccgccccgcgcggtgccatgaaatcagcgccggactgggcggtgtcttgcgggaaggtgtaggtcaggcgtgcggtgtagacgcgcacggccgaggcctggtccgcgaccggctcggtggccaccgggtccagaaaatcgttggtgtagccgcccgaaccggaggccttggtgttggcgatgcaggcggcgagggtagtgccgtggccgtccgcggcgcagcgggacaccagatagtcccgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagtgcgggccatgatttgcggcgcgagttcgggaatcatgccggccagcgcgataccccacgaataggcgccggtagtgtggccggaggggtaggaactgtttttctgcaagttcgagtagccgggcacgtgttcgagccatgagggtgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcgttgagtttcccggatttgagcccttcgctcatatatttgccaagcaccggaccgagcgcgtccggcatggcttcctcggcttgcagatcggagtcgacgagcgcacgcttgcgttgggcgttcaggccatccttatcgagattttcggcggctttgtggttaatggccacggccaaatcttcgtcgagtttcattgtatcggcgtcgagcaccttgccaccgtgttcggcatcggtgggggcctgccaatagttcttttcgtagtcggagagcaatgccacccaatccgggttgggcagctggtcggcctgtgcgattgcaggcgtcacggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgaccgtcaggcctctgactcgtcttcggacttgcggaacgccgggaattcgccggtttctgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgagctccttggccaccgcgatctgattgacgttggacgggtctccggcggcgatcggcgccacgggctcggcctcggtgggcgcggccgtgcgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtgtccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaagatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcttcacgttcgatggcgggcttccacagctcccagctgagctggttctcgccgtccggcgggttgtgcaggcgcatgaggataaacacgagcaccaccgcgaacagaatgcccgcgatccagttgacgatgcgaatggtgcgccggcccttgggacctggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcaggccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtgtcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccataagctggacttcggaggcgaacttctccttgacggtggcggcggaggtcgaaccggtgacggagcataggcgcttgccgttcaggtcttcggggccgttgatggagttgtcgtccttgcgcacgagcagatcctgtccggccacgaagtacgggccagcgaaggagacggccttcttgcgctcgtcggtgatggagtaggtggcgaggatcatgtccacgtcgccgttctgaatcatggcctcacgctgcttggagggggcttccttccagatgatctggtcttcggaatagccgagtttcttggcgacgtatttggccacgtccacgtcgaagcccacgtaggtgccggacttcttgaagcccaggccaggctggtcgaatttgatgccgatgcggatcttgccggtttcgtccgcgccgcaggctgccagcgacattgtgcaggccacggcggcgagcgcggcgatcacgcggcaagccttccgtttgaacgtattggtgaatgtcattggattgcgtacccgtctttcagtgggttcgtcagtgggtgaggatcttcgagaggaagtccttggcacggtcggtctgcggatgctcgaagaactcgtcgggcgtgttctcttcgagaatctggccgtccgacatgaagacgatgcggtcggcggccttgcgcgcgaaacccatctcgtgggtcacgcagatcatcgtcatgccttcatgcgcgagttcgaccatcacgtcgagcacttcgttgaccatttccgggtcgagtgcggaagtgggctcgtcgaacagcatgaccttggggcgcatggcgagcgcgcgggcgatggccacacgctgctgctggccaccggagagctgggagggcatcttgctggcctgggagtcgacgcccacgcgggcgagcaggtccatggccagttgctcggcttccttcttgtccatgtgacgcaccttgatgagggccagcgtcacgttttcaagaatggttttgttggcgaacaggttgaacgactggaacaccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggcgacggtcaggttgatgtccttgagaacgtgcaaagcaccgaagtgcttttcgacgtgggtcagttcgactagcggacggttcgggtcctctttgccgggaaccagcggggtcaatttggccttgctcggtgatgttgtgcttgtcgcgcgcgaacgcactgctgtttcattgttcgtttcagacatgagtgggaggatagcacaccgacgtttccaacgtgttcacagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggctgagacgttgctgcgacggcaaagcgggcacgtgttgtcctatctgctgattccatgtttggccttggtgtcgttggcgttgctgccgcgtatgccgcagtcgggcgcatggctggcggtcactttgtattgtgtggggctggtctcgccgtttcccatgtcgtattcgtataaatgtgctaggcattttgagcgtggctagctgttcgcacacgatgagtgctgttatacggtggacgacactcccgaagcgcggtggataaccgggcgcggcacacgatatgccggtggataaccggttcgcgccgcttaagttatccccattttccagttttgcccctatgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccacagaaggacttttatgtgacggtgaggagcaaagggacccgctcttcattggacaatgtcgactatcgcatatggaatgcaaagttcagcagtatcgctttttcaaacggcgtaacctgcatgcatcccatggatgcgtggatacagtttgcccaatatctcaacctcaccgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcctgcccataccgcaaacacaatacggcattaccgattcagagaacggatacacctataccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagccttaccatcaatgcgcgcaaaggggaatacaggaggcggaaacaagcaaaacacaacaaagcctcacaacattgatcaaatacggagttgcgattgctcctcatggggcggcaattcccccatgaggcggcaatttgctcatggggcggtttgaagaaattgtgaaaccgcggaattaagccattttgacctaccgccccatggggttttcaccgccccatgggttgtttaccgccccacgaggaagttaccgccccatggaaggataaggcagattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtagtcctccgggtagacggataggtcggtgcctttggggaagtactggcgcaggagcccgttggtgttctcgttggtgccgcgctgccacggggagtgcgggtcgcagaagtagacggccatgtccagcgaggcgccgatccgtttgtgcagggcgagttccgctccctggtcccaggtcaggctgttgcgcaggagtttgggcaggtgctgcatcttgtcgatgatggcctgctggacgtgttcggcgtcgtgcccgtcgggcaggtgcagcaggatcgtgtgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgagaagggcgcggtggagtccaaggtcggcatggtgcggcgcaagctgttcgtgccccggccgagcgtatggagcctggagaactttaacgccgggctgccggaccggtgcctggagctggccacgaaaccgcattgccgcaaggacacggaggaacgtggcctgttctccgaggaccgtgcggcgccgctgccgttgcccgggaagcgtttcgacgtggtcacgtggcggcatatgaaggccgaccggtacggcgtggtcacgctcgagggacggcatcgttattccgcggaccgggcgaacgcgggcagttttctaggcaatttccaatctaacgggtgttgcactttcatttagacaacgggtgcgcgctccaagtagtgcgcccggcgtaagctgggttcatggagagcaaaccgcccgcagtgcactgaagccagtgcgctcgggcggttttgcgtatgcggggttgaaggtcgtgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactggccatgaaggaccgccgccgcccgcccgaagcctctgcggaccagcctgaggcccaggctgtgcgattggcttccgccggttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccacacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcacttggtgtgatgttcaattcgtttacgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgcgattggtctggggctcgcatggggccttggcgtctggtccaccggcactgcccgtgaaaacggcatgctgctgtttgcgttgatctccggattcgccttcggcatttacgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcacagcttcggctattacctgctcttcccgtccgccatcgtcatggtgctgctggccggaatcatcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggctgatatgcgtgccaaagtcgagtccgcgatgcgccagctcaactacattcccaacgagctggcccgcaacctctaccggaaccgcaccaacaccatcggcgtgatcatgccgaccatcgcccacccgttcttctccacactcaccgcgcatctgcagcgcgagttcgccgcgcgcgacctcaaaaccctattgtgttccaccgccgatgcggacaaaggcgaggtcgaatacgtcgatatgctgcagcggcacatgatggacggcatcatcatggccgcccacaccgagcatccggccgactactggacctccatccatcggccgattgtcgctttcgaccgcacgctcggtgagggtgtgccggtcgtccggtctgatcatgaacagggcggccgtctgattgctcgccagctcatcgattccggagcgcgccacgtggtgctcgtcggcggcccgcgctcccagttcgcggcggccaccacgttccccacgattcgctaccatctcaccgtcgagcgtctgctggccgatgccggcattgcctgcgattacgtggaagccggcgccgtggccgacatcgccgcccacgaagccaccgcatgcgccattttcgagcggtatcccgatgtcgacgccatcgtcggctccgatgtggtggcatccgtggcattgcaggaagcctcacgccggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccggccaagaacgatagcgcttcggacgttgacatccaacccactcccgaagaagtcatccccgtagccctcatccccggcgaaaccacccggtgactcctatcttggctcccctctctctgaggggagccgaggcgcagccgcgcacagtcacccatctcacatgactcctacgtcacaatgtccacaatgtgaacccttgctggattggcaagacagccaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcattgatgcttgaagccccgtcaacgaaggcagggccaatcaagctgacacaatcggtaaggccctgcaagatgcggggcttttttgttgcgctcacaaggcttacggcagaatcccgcagacggaaacggtagcggacagtacacggcaacaacacagcaacagaacaacaacctccctgtgagacgaaataatcgcccaccaatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccatcgccttcatcgcccgcccgctgggctcgctgatcttcggccacttcggtgaccgcatgggccgcaagaccacgctggtcgtcagcctgatgaccatgggtatcggcaccttcctgattggctgcctgcccacctacgatcaggtcggcgttggtgcagtcgccatcctctgcctcctgcgcttcatccagggcatcggcctgggcggcgaatggtccggtgcggcactggtcgccaccgagaacgcgcctgaagacaagcgcgcgctgtacggctccttcccggagctgggcgcgccgatcggcttcttcctgtccaacggcacctacttcgtgctcgaatccttcaacaatcaggacgcgatgctggcctggggctggcgtgtgccgttcctgctgtccgccatcctggtgatcgtcggcctcgtggtccgcgttcacatggaggagaccccgatcttccgtatggctcaggagcagaagaaggtcgtcaagtccccgctgaccgaggtcttccgcaagtcctggcgtcaggtgctgcaggccaccttcctcgtggctgtgacctacacgctgttctacacgctggccacctggtcgctcgcgtggggcaccaagagctccgccgacggcggcggcgacctcggcttcagcaaccagcagtatctgctgatgctcatggccgccgtatgcgtgttcgcgctgttcatcgtgctgtcctgcgtgtacgccgaccggatcggccgtcgccgtgtgatcgtcttctcgtcctgcgcgctggtggtgttcgccttcgccttcccgttcctgctggacggcggtctggtgggccagcgcaacttcgtggccacgatggcgttcctgtgcgtcggcttcatgctgatgggcatcgcgttcggcccgatcggcgcgttcctgcccgagctgttcgaggccaatgtgcgctattccggctccggcatcggctacaacctcgccgcgatcgtcggcgccgcgttcgtgccgaccatcgccacctggctgtccgccaactggggcgtgcactcggtcggcctctacctcgccgtgatggccgtctgctgcctgatcgccgtactgtcctgcaaggagaccaaggacgtcgatttcaccaagtgataccggcggttgatcgacacccctcacgcggttccgactccgttcgggtgccgccgggcggttggcgcacattgcgccaaccgcccgtctgtattcgggggtgggccattggcgcgcggcggcgcaccgtggtgcgtaatggcgcgcagtggcggccggcggacatctatctgcggtaggaggggcgccgaatacagaggggctgacggtgcttaccccaaccgacaaatcagtctatgaaaatagcgaaagcttcacaaaaccgggccatcagggaatacgtgtccaacgtgtgatgatgtgatatttttgcattggcgggatgttgattaaattagggcgcttatctgcttccggacatgatgattagacaacaatgaatagtgtgtgaatggtgtatgaatggtgaatgatattggctgttgttgctgatgtatgctgccttgatggggtaagattatcgtgtctgtagaaatggggtgcgctatgcgcatgaaagcaatgagtatggtcttctgtgcccttttcgtcatcggagcattgggcgcgacgccttccgcattcgctttagatggccgcgccgaggtgagtaatgcttttgcatatttattgtcaaccttggctgacgtagagagtgtgctttcagagaacgttgagatttccaattcgattttgtctgtcgagggcgcaaagggtggttttcgtgccgcgaaagcggactataggttatctgacaatgcaaaaaaatcgatagaggagatcaggcaatattctgtagatcgtgaagagaacatgagccgatacggcgatgtagtacggtcgactgaaattattccggagtatatgaccgtcgtttcgtctgatagcaaagatagtgtttttcagtactctgtattgtataagcgagatttgcctcagctttcggaagaaggtgatgaatgggtcgagcgagtcgaatatgatgttgaattcgggggtggtggaataatcgagaatatcattgctcgcaatctgaattactatctacagcaagaagacgattttgagaatattttgccggataatgcgctgatggagcgtttggaaagatcgacgacatcggtaaatcgttcatcaattgtttcgtatgcgacaaaatatgcttacaactataatccagcttatatcagttatgcggctcagcatgctgattgtaccaattttgcatcacaggcaatgtatgcaggtggatggaagaaaaactatgaatggatggggaatgatgtggccacgactaatgcttgggcggtcgctgatgatttctactggtatgggttggggcgcagtcttacgacttatgcaaatatgattcctgtatctggttctccttatcagacgatgagaaccggagacttgatgttctttacatattcaggtagtagaaaaattaaacatgcaatgattattacaaagataataaatggtgaagcgtaccttacatatcattcgaacgataatctcaatgctccgttttcgtcaattgtaactaaagtagagccgaacacatcttttgtgacgttgaatgtgacgccgtgattcatatgtttggtggaacattgaggcgaacggttgggtttgtggcggtgatcgtggcggtagcttcgggatgttcgggatgcgtcgcgcgttcgaatgacgcatgcggatatttggcgtcgaatatatcggtgcgtgatgcagtgaatacgttcgtgcgcggcatcgccgatcgcgacgtggagacaatctgttcggtcgtcaccggcagtgaaggccagtcgccgtcccgagaacgtatccgtgaagcccttccggacgtcgccgataatctggcggacatcagcggaggtacgttcgcgtttggggtgtcggtggaggatgggttcgacgagttgtataacgtgggcctttcgtataacgggcgaagactggtgattgcctgtgagggagatagcgtggcgtgcgattccgggcagcagttgacgttgctggttcgggctgatggatatgcgcgtgcgattgcgcggggagagcagtcgggcatggacgtgaggcgcgtggtaacggatgacggtgccccattcgcggtgatatggcggccggaatcgttggcgcagtgcactctgggtgacggatagccgattcgggatggggtgccagttgtcgccggatgaatcatgtgggtctgctgcgtgctgtgcgatcggccggtgcatgccggcgccaaaggaaaatcggccggtcacaatgtggacatgggggacgtccgtgggtcggggaggactagaacaataccccagaaggggatgactttcccgcggggacacaatccgccacgtcggaagccgtccgcaatcaacggattgccggacgcatcatgcgctcgacagcatcgtcaagacatcaaaggagcgccaatcatggcagcaactatctggtacgagaaggacgccgatctgtccgtgttcgatggcaagaaggtggccatcctgggctacggttctcagggtcacgcccacgcgctgaacctgcgtgactccggtgtcgacgtggtcgtcggcctgcgtcctacctccaagtccgtggagttcgccaaggagcagggccttgaggtcaagccggttggcgaggccgtcgctgaggctgacgttgtgatgattcttctgcctgaccagtaccaggcagccgtctacaagaaggacgttgagccgaacctgaagccgggcgctgccctggccttcgcccacggcttcaacatccactacggctacatcaagccgtctgaggatcacccggtgttcatggttgccccgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactacggctacatcaagccgtctgaggatcacccggtgttcatggttgccccgaagggcccgggccacatcgttcgtcgtgagtacgccgctggccgtggtgtcccggtcgtcgttgctgttgagcaggacccggacggcaagacctggccgctgtgcctggcttacgccaaggctctgggcgctctgcgtgcaggcgccatcaagaccaccttcaccgaggagaccgagaccgatctgttcggtgagcaggacgtcctcatgggcggcatcaaccacctgtgcgacctcggcttcgacgtgctgaccgaggctggctaccagccggaaatcgcctacttcgaggtgttccacgagctgaagatgctggtcgacctcgctaacgagggtggtctgaacaaggctcgttggtcctgctctgacaccgctcagtacggcgactacacctccaccgtcatcaccgaggagaccaagaagcgcatgcagtatcagctcaagcgcattcaggatggctccttcgccaaggagttcatggatgaccaggctgctggcgccccgaagttcaagaagctgcaggaagagtactctcacccgcacctcgagaccgttggcccgaagctgcgcgccatgttctcctggaataacgccgaggccaaggacaaggatgagaccgagtccttcaacggcaagattgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaaggtcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgatttcggtttgaaggacacaatcctcgcaacacaggacttatctgcacaccgtagataccccggcgcccagcggcgccacaccccactactgaaaaggagtgccaataatggcagcacaaatctggtatgagaacgacggcgatctttccgtcctcgaaggcaagaaagtcgcaatcatcggctacggctcccagggccacgcccacgcgctgaaccttcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgatcctggcccccgaccagtaccagcgcaccatctgggccaacgacatcgagcccaacatcaagccgggtgctgctgttgcgttcgcccacggcttcaacattcactacggctacatcaagccgtctgaggatcacccggtgttcatggttgccccgaagggcccgggtcacatcgttcgtcgtgagtacgccgctggccgtggcgtgccggtcgtcgtggccgtcgagcaggatccgcgtggcgatggttgggctctgaccctggcctacgccaaggccctcggtgctctgcgcgccggtgccatcaagaccaccttcaaggaagagaccgagaccgatctcttcggcgagcagaacgtgctcatgggcggtgtgaacaagctcgtcgagatgggcttcgaagtcctgaccgacgccggctaccagccggagatcgcctacttcgaggtctgccacgagctcaagatgctcgtcgatctgatgaacgagggcggcctgaacaaggctcgttggtcctgctccgacaccgcccagtacggcgactacgtcaacaccgtcatcaacgaggactgccgcaagcgcatggaataccacctgcagcgcatccaggacggctccttcgccaaggagttcatcgacgatcaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattcttccttggctcccctcgggtgaggtgcgcacgaacagcgagccggcaatcgcagccttcaggctgtccgtgttgcagtacgctggcgcgtaagcgcctgagggtggtccccagtgcataccaaaaggccgccgctccgattcattcggaacggcggcctttcgcttattccaagggatctacttgataacccacgcagaagtgtcggtggggagctggccttcgggggtcagcgggccggacgccagcaccacggagccatcgggcagcgcgaccggggcattgccgaagttggtgattgaggtgaacacccgcccgccaaccgccgcgcgggtgtacgccaccacatcgtcgcccatgtccacctgctcggccgtggtgtcgcgcgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggctgcgcacagcggcacatggttttcgccggtaccgtcatcggccggagccggacggctgaaatcggccaaggccggctcatcggcggcggtccacggcagcggcacgcggcagccgtcgcggcccttgtccatcgtgttgcgggtggtgtggaaggcggtcggatcctccaagtgatcccacggaatatcggccacctcaaacaggcccagttcctcgccctgatagatgtatgcggcaccgggcaggccgagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttgagcccggcggcgatggccttgcggaactcgtcggcataccagttggcctgcgcgaagtcgaagttgaaggactggcccagctcgtccatcgaagcgtacaggtgctggtgctcgggcaccacccacgcctcggccacggcgaagcgcggcggattgtattcgttgaacaccttgcgccactcgcggtagatgtcgtgcacctcacgacggtcgaacagcgggtggctgaagtcatgattcagcacgccgaccacgctgtattcgcggccgagctcttccaacggcttggattcgagatccttggccaggccgtgcgccacgtcgatgcggaagccgtcggtgccgtggtcggaccagaaacgtagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttgggcggcagttcgccgtgctcgccgcggccgtcgcggaagatgtagcggtcgcgcgccggggagccgggctcggcggcgagggcctcttggaagaacacgtgcttgtcggcggtgtggttgggcacgatgtccacgatcactttgatgccggcctcgtgcgcggcctcggccatcgcgtcgaagtcgtccatggtgcctaggcgcgggtcgacgttgcggtagtcgatcacgtcgtagccgccgtccgccagatccgaggggtagaacggggagagccagatcgcgtcgacgccgaggttcttcaggtaatccatcttctcggtgacgccggcgatgtcgccgagtccgtcgccgttgacgtccttgaagctgcgcgggtagatctggtagacgacggcctgcttccaccagtcgtcattgaggttgttggcggtcatgccgattccttcctgttccgggtgcgttgtggttgggttgttccggttgcgctcgaactgctgtgtgaaggcccaaccgttgtattgatgatgacaacgatatcatgtgaattacgcatgcaaaagtcgatttatcggcgttttgcggtggtaacgtagtcacgcctgcgcggacgctgctgttgcggcaggcggcgcggtggtttcgcgcagtattagcggagtgtccggccgtacgaatgccggttcgattgacttgcccgcaatggcatccaataccatgtgcccggcggccacgcccattgcgaacgggtcctgatgcagtgtggtcagtcccacggcggcggacagggtggaatcgtcgaagccgatgatggagatgtcctgaggtacccgccgcccgtattgacgcaggcgatacagcacgggtgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatgttggtttcggtcggggcgctgccgacgaacgcgatatgccggtggccgagtgcaatcaggtgctcgatggccgaacgtgtggcggcgtaatcgtcaatgctcacgcctgcgtcgaacccatcggtggagggaatgttgatgccgacaatcggcacgtgcatatgcttcagtcgctccacttcagccggctcaatgtcgaaggagctgacaatcaccgcatccgcattgcgtcgcacgggcaaatccgcaaagaagtcatggcgctcggcggcgttgcgcatggggtagggcacagtgtcgtagccggaggggcgcagcgccgagtcaaggccggcgaagatgtttgcattgaaccaggtggtgatggtctcgctggccagcagcgcaatgcggaacgactggccggacttcagtgcggcggccgagcgagagacggagtagtcgagcttttcggccgcggtcatcactcggtctcgagtctctggaagcactagatccggcttggcgaaggttcgggacaccgtggatacggaaacgccggcctcgcgggccaccgcttgaatgcttgccttggtcatatgccgtcgctccttcgccgtcgcgaacaatcattgtcatgacaacgataacatgcccataacaagtcgtcgtcttcggctatctcgattgcgaggggggtgttaactgttgtctatattctattgtttcctttgtttcagtatgttataattgagtcatgcgtgttaaggaatgggctttccgtgaggggttgaacgagcagacggtgtggctgtggtgccgtaccgggcgcatgcccgtgcctttcgaacgcacttcgacgggcgtgatacttatccacgatcccaagtatgagacggaacccatgaataccgggcttcgaaccgtctgttatgcgcgggtctcctcatccgaccagaaagccgacctgcaacggcaggccgaccggttgaaggcgttcgccctgaatatgggtgtcgacaacccagagacggtcacggagaccggttcaggcatgaacgaccggcgtcgcaaactcaacaaggtgctttccgacccgacgatcggcacgatcatcgtcgagcatagggataggctcgcccgcatgaacgcgggactgatcgaaagcgcgttgaacgcgcaaggccggaagctcatcgtggtggacgacacggaactggacgatgatctggtgcgcgacatgaccgaggtgctgacctcgttctgcgcccgcctctatgggaggcgcgcagccaagcgcaagacggacgcggcgttgaaggcggcgcatgatgcttgaggccgtcaaggtggcgctcgacccgacgccacggcaggaacgattgttggaatcgcacgccggggcggcgcgattcgcctacaacaagggactggcgcacgtcaaggacgtgctcgaacgcggcgatgcccccgaatggtcgtactatgccttgcgtaagtggtggaaccaagccaaggacgcactcgccgtggacgaggccacgggagaaccatggtggcctgagaacagcaaggaggcatacaacagcggcctcgaatcattggccgacgcgctgaagaacttctccgagtcccgcaaggggcggcggaaaggccgcaggatggggttcccgcgcttcaagtccaaggactccggcattcggcgcttcgcgtatacgaccggctcgttcggccccgtcgaccatgacccatacgcgctgaaactcccgaggataggccgtgtgcactgcatggaggacgcgtccaagcgagtggacggcgcgaaggtgctgcgcatgagcgtgtcccgccgtgcgggacgctggcaggccagcctgaccgtcgaacgagccgacaatcccgcacccaagcccccgaagggcgggagcgtcggaatcgacttgggcgtgaaggaactcgccacattgtcggacggcaccgtgatacgcaacccgcacgccttgaagtcgaatctcacgcgtctgaggaaagcccagcggagcctgagccgcaaacgcaagggctccaaccgccgccgcaaggcgagggcgaacgtggcgcgcctgcacgcacgtgtggccaacctgcgacgcgacctcttggacaagaccaccaccatgctcgcccatacctacgcggacatcagcatcgaggacctgaacgtggcgggcatggtcaaaaaccacaggctcgcccaatcgatccaggacgccgcattcgcggagttccgacgccaactgacctacaagaccgcacgcaccggtacgagactgcatgtcatcgaccgctggcatccaagctcgaagacctgctcgaactgcgggacggtgaaaaccaaactgtccctgtccgagcgcgtctaccattgcgacaagtgcggactgtccatcgaccgtgatctgaacgcggccatcaacatccaagtcgccgggagtgccccggagacgataaacgcgcgtggaggaagcggaagacagacccgtcccaagggcgggacaatgcggcatccggcgaagcgtgaaccaagcggcggcgagagtcgcgtgagacttggagctggcctcggcaacgaggccatgcagatgacttcgctctagcgacaagctaaaacaaagtcatctacaacggctgatttagaccaatttcccattgccggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggagcggcattcgcccacgccgtccaccagcgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgctcggccatcgccgaggcggcgaatgcctccaccggctcgctcaggagatgcagctcctcgcgcagcttgacgtgtgcgaagttcaggtagccggcggtgggtggcagatcgtgcgtggtcaccgaggccaatgcctgtttgcgatagtccttgggtgcgcggtacgggtcgccggcgttcggcgaatcgtccacgcggttgaaccattccacgtcagtgccgagcacgccgtgatcggacagaatgcggcgcacgtaatccggtacggtgcccagatcctcgccgaccaccatgcctccggcgcgcgtggcctcgatggccagtactcccagcatcgcctcgtggttgtacgtcacgtatgcgccgttgcgggcaccgagcccctgcggaatccaccacaggcggaacaagcccagcacatggtcgatgcgcaccgcgcccgcgtgctcgtacatcgaatgcaccatctcgcggtacacctggtagccggtggcctccaggtagcgcgggttgaacggcggctggccccaatcctggccctgctggttatagaagtccggcgggcagccgaccgtgacgccacctgaggcgaagcgttccggattggcccaggcatccgcgccgagcccgtgcacgcccacggccatgtcctgcatcagccccagcgtcatgccgtggtccagcgcctcctgctgcgcggcgttcacctgctcggcagcgatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccatgtggcgaaggaatcgaggtccgggccggcggtggtcttgaaatgctcgaattcaagctcgcgcttgttgttgcggcccgcttcgaagatcaggcgcagcgccgggcgcttggcctcccacgccgcgttgatgtccatcggggtcgattcgtcgttgcgcgcggccaccgaatcatgcagcgcatccacctgcgcgcgcacgtcggccggcagtgtggcatattcggggatatcctgcggccggatgtacgtcacgttgaggaatcggcgcgattccggtagatacggcgaaggctcgagcggcggaatcggcgcaccggcgtgaatcggattgatgagcatgaagtcggccttggacttgctggccgcatccctcagcagtagcttcaaatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtccaccgtgacggtcagtgtgtggtagcccatcggcaaatcgggggcgatggtcaagtccggcttgccggaattgaggttcggcagcagggcaaagtggccaaacgcggtgccgtcctccagctcgatggaggcggtgatgtccgcgtccgacgagcagttcagggtgatgccggtcggtttgccggtggtggcgacgatggtggaggggagcaaacgtttgctgttttccacctcaagttgggtcatggagcgtgcgatggcctcgtcgctggatgcgtccacgtcgagggccttgagcacggcgaccaaggcctcgtcgctgatctcggtgtaggtgccgagctggtcgatgaatgaggtggcaagcccgcaggctttggccagcttgaccagcggacgggcgagccgctccgcgctttccgtgcgctgcggggtgtcggaagcggcgtcgttggtggtgtctgcgatggtgccggtgctggttgctgcgtcgttgccgtatgcgtcggtcatgatgactccttgcttgcaaatcgggtactgctagtcgtttgcattgctgttcgagggccgctctgcgttgaggttccggcaatctgacagaccaatgttcgagctgttccgcctctaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccgccaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgtggcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccgcgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgttggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacacccgtatactgaaccgtgttcacttagagcttgcgcggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgatggctgggccgtcatcgacgattccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcaggacggctatctggccctgatggaccgcttcaagcgcgagggcatcccgttcaccacctccgtgatcgacatggactggcatcgcgtggacgacgtggacccgaagtacggttccggctggaccggctactcgtggaatcgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggtgtcgacttctggtggctggactggcagcagggcggcgtgacccgccagaagggtctcgacccgctgtggatgctcaaccacatgcactacctcgactcagggcgcggtggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactatcgtgccgccgaagccggccgtccgctggtcgagccgatgtactggcagaacccggatacgccggacgcctacgaggtgccggatgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgctggccgccgactggaggtctggcgctcgctcgaccgcacgccggtgttcgccaaggccggcgcgatcgtgccgttgcaggacgtcgcggaatccggcgaagcgatcaactctatcgccaacccgcaggccctgcgcgtgctggtgttccctggtgccgacggctcgttcgtcatgcgcgaggatcgcggcacgtggggcgcccccagcgccgacaccgcgatagcgttcacgtggggcggggccgatgcgtcgcccagcgccttcaccgtcgcgccggttaccggcgatacgtccgccgtacccgagttgcgcgactggacggtcgtgttccgcggcgtcgcgccggttgacgcggccagcggcgtgcgtgcatggtccggcgaggctccggtcgaggcgacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattttgctgcgcagctgagcccggttgcagttttctgcaacatccgggtgcgccccggtatgcggcgataagttcggcatggttgccgaagagcgtggcataccgggtgcagtgcgtgggatggccttcgcgattgcactcatcgtgcggtcagtggaaaggaacttttcatgcacaaggtgaaacagcacaagggcgtcgcggtggccgccgcggtctgcgcggtcgcgatggcggcctcgctcgcgacccacgccggcgcggccggggaccggcgttattgactggctggcgttatcgagtgattggcggtatcaattagccggcgttattgatgagccggtgttgtcgattagccagcgttatcgaccggcactgaagcatgcagtacccactgcccgcgtttctcccgcacatcccaatccccgtgcgcatgcagcacacgctcccgatagtacgcaagcccggaatgccgccccctcaaacgtcgcgtcaccttgacgcggacggtccgtcacatcaatggtgacgcggtcctgagcggcggaaaccagcaccacgtaacgctgcgtcgaatcggcatacctggcgatattgccaaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccacctcggtggtgatgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgcacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgccgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacggtcagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcacgggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagactctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggagatacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcgaagccgtattcatgacgagcggaaccacgcatggcggcaagatgcgtgggcgcaacttccatcccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgttcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgcgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggacctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccgcacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcggggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattatttacggttcttcgcagactaccaaattgattgcgggcaaagtcgccgggtccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcagatacattggccgaggtcggtgtgaatcgcatctgtccgctcggtgagatggatcgggcgaaatccggctggcatcatgatgggggcttcaacctcatcgatctgttgcgcgtggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggagtgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtgcaagacgtgctgcattcgctcaaggaagccgacatcccatccatgctggtcactacttcgcctcgccgcatggccgagaacatcatgaagcaggctgatggattgcttgccggctacgtctgcggcgatgatccgtacgagcacaagccgagccctgccccatatctggccgcggctgagagactcggcatcgcgcctgaagacatggtcaagtgcgtggtaatggaagattcctcatccggtctgcgctccggcgccgcctcgggggccacactgattgcgcagactggctggattcgcaccgacacttccggccttggccagtttgcctccatcgactcgtatgagggcatcgatgcggccgcgctggacgcctttgtgcggcagcgtttgggggagtagaaatttcgtttgtattgcggagtttgtgtgggaaaccccagtcgacctgatgttataggccggctggtagggtatttgacggtttgcatataactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccgcataaggaatcgtcgtgaaaatgaaggccctgactgtgcatatgaggtcagggccttttctgcatgagatgggcgtgaaacaacagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcactcgccctaactacagacaccagcttccataacattgtgacgatgacgtcaggtcatggaggcgtggggttgagtgtcatggcttccatgcttgcatggacattggcgagacgtgaacacagctgcgctctcatagacgctgatttcgtggccggatgccttgacctgctgctgggtgtagaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggagaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtcttgtcatgacagccgcttgccgggcgaggaaccggccgtagcgcatgattgcgggtcgtcatggaccatactcatattgcgtatgtcgcaggtgtccttgcgtcagggctcctcgattccccgggcgcttgacatggtgggcaaagccgtcggcggcgactgcggcgctcgcatgagcgaggtcgggagatccctgaccagaggggttccctgggctgatgcgtggcatgccgctatggctgttcagcatgagggcgcgccagctgatagtccatccaagggaaatacgaataccacgcaacgaaatcttggcctgctgcaatcggctttggaatcgtcatggacgcatggcgatatgcctggcgtgcgcctcgactccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtattgctcggtattgcacttggctgcgtttggttatccacattggtggtggacgacacgtcggggtgtggataactcggcaagctagaaccacataccccgttttccctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacgggatcggccaccgccgaattcgcaatcgtattgcccagcattatcgccatcgccgggctgatattggcaataggacgtgtggtcatcgtttccatggactgtcaaagtgccgcggcagcggctgcacgcgagtttgtggttaccggtgacgaatcatccgcgcgcagcatagctgcggacgttgccgggggaaagccccacgtcagcattgcccacgacggccaatcgacgagtgtgacggtcgaatgttcggtattgcccggtccgctggatgtaactccaacgcgggttaccggcaacgctacggcgataagccaataacggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataacttcgacgtcatcgacatcaccggcacgagtttcgacgattccctgaaccaggcgcgtgaacgcgcgcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacgggaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcaacggaaggagacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcaacgccattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgaggggagtgcgggagagcggtaccagagccaatgcccgtcagacctcagacgacatagctttcgatatgcagcgtctgcgccatgacctctttgatggttcggtcgctgatgttcggatgcgagcgaatcagtgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagtacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtggggcgtttctcgtcgaggatatcgctcatgggtgcctcctgaccacaaccgttattgacactatgttaatacaaagaaagcggttaataacaataaaaatgcggtaaccgttgtcaggtgaatgtcgttggaatataaagagttttcccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctgggttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggcgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcggctgcttcttcgacttcgactacgtcagccgcttccggtacgggtgccagtggttttgccggcgcatcgcggggcgggtttgccggagcctcacatggcggattctccggtgctgcacgcaaccagcaagcagccgcgcctcagagcaccgcttcccatgaatctgttggaggcaacggccctgtcaacggcccggtcagcgaccgacccgcgggctctctgtctgtgcaacctgctgtagcaactgctgctgccggtgccgctcctgccgccaatgccgggtggggcgcgcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggccccaaccgtaagggtctgccttgcttgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgagcctgggcattcatatggggagcgagacgaaagctccgaagccgactgcaacaggccaagccgaggacgcagacgacagccatcgagccggacaatccagtgcatccacggcagcgaagaactggagtgacgatgacccttgggccaagccggccgtaagcaacgcttcgccgcaatctgcagacgggttcgcacctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgttacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggggccggcatcggaatcgccacgcggtgcccggagataagcagtcggtgcgtgttcacgccgtatggcgtacaggtcatcaaagtgacgcgatcctcacccggcacgatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaaacggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtaggggggcataagaagtctgaaaatgcgatacgaacaacgttgctacggctgtcagtgatgcggcttacttcggacaagccgttgagatgcaaggggatgcaaaggattgcaaagtatggcaacatgataagtcgcagcgtcggcgatatttggcagagctttcaaataggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcctgagcaaaagctcattcgccggattgccgaacgtcaaaggcgcggttgcagaggatgcgcggatcacggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgcgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggcatcttcaccgccgacccgcgtatcgtgccttccgcccgccgcattccgtccatcgattacgagtccattctggagatggcctcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtattcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtaggcaaggtggccgtggtgggcgttggcatgaagacccatgccggtctggccgccaagttcttccaggccctgagcgatgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagtttcaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatggccgaacaccttgagcggctccttctcggacttcgcttcctcaccggagatgaacgggatgatgttgcccaccatctcgggccaatccttgaaggtcttgcccgcgccggaaatcgcctggtaggtgctcacaaccacctcgcgcggctcgaattccttccacgcggccagcgccggcgtgtaggcctgaatcgagcagttcggcttgacggcgatgaaaccacgagtggtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgtttaccgcagagaacatgaaatcaacgccagaggccacggactcggcatcgtcgccatcgacgaccaccatgttcttaacatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcaatttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcctcaagacggcttcatgccgccggaaggcccgttctatctggtcgtcaatccgcacaccggcacgtgctatatcaatcgcgagccggatgtggcccgcaagcttatcgactccgatgagcgcctgccgctcaccctcgaggaaggcttggccatcgccacccagcacccggagtggctgctggaaaagaacggcttcaatctgctcggctcacgctccgcagacggccgcgtgccgagcatctggatgagccagaacgcaccgcgactgggagccgtctggcccaattcccgccatacctggctgggcaacgcgtattgcacggcccgtcgcggggtgagtctgttccgttaaagcgattctcctcaaaagacaaggtcggcaaggtggcgggttccgacccggctcctggttcgtcagtcagctctggcacggacatcacgctgtatgaaggtgtggacgcggacagcgtcaacgacttgatgatcagtaaaatcacgggatttaacaccatcaatgaactcaatacggccgtagtgggcacatattgcaaggcgacgattgccgatgccagcaaggactgcatgacgttgagtgcaggtcccaatagctacggtgacccaatcgtgtatcaggaatggggcggcacgccgagcgacagtccggccgacaaagatcgtgtgaatcagtgctttgcctcgaatggtggcgatgtcggccgatgcacgatatccggtgagggagtcggctcatccggtggtggtgcttccgaccgcttgattaccaaaaactggggtatgttcgatcaagacggcggccaagcaaagcaaggtggatggcgaccgcccgttgtcggcgcatggggaaccgtaatgaaagtcaataaggatggcaccttctccggctcctaccatgactcggatatgggggccacgggagacggctatctcataggaaacgacgtcgatacgctgaacggcaaagcattgctcaacgtgacgagcggagcggataagggatacacgttctacgatttctcgtagtgattcagctgccgtgcggagcggcggggaacgtgaaggaccggcgcgtatgctgtgcgaaacagcattacgtccctagactggtgaggcatgacgaacctgcgattccgcgaagacggcagcttccgcgtgctgcagatggccgacatccaagacggccccaacgtgctccccgataccatccgccttatccgtgaggccattcgcaaagccgacccggatctggtggtgttcaccggcgaccagattcgcggttacgatcctgcctacatcgacactttcctgcgccgccgtggcgaggaaccgggcgctcgcgtgcgtgcggtcaccgaagtcgaggccaagctgcgcggaatcaagcggcgggccagagaccgcgtgaacaatcgtctgctggccatgaagtctgacggcagcaatcccgacgtccaacaaaccgcgtccaccgcgtccaccacgtccacgctggtctactccacaacatccgattcacaggatgtgccgacgactttggacgagctcatggacgagacccgtgacaaagtccgccgcacgtttgccggcttccttggcccggtcatcgaagcggaagtgccgttcgccgccacctacggcaatcacgatttccagtgcggcatcctggccgacgagcaggacggcatctaccgcgaattccccggctgcctgaacccggtcgacagcctcgagccaggcacttttgccctgcccattgaggcttccgacggatccgggcgcgtagctatgtccgtcatgatggtgaattccggcgattacgccggcaagcctgaagagaacgacgcccaatacccggcctatgtggtcaatccgcgcggtcttgatttggctgattccgatgggtatggcacgccaagccccgaggcgatcgattggctgggagccgtacagtccgaacttggcgaacgcaacggcgacggtaagccggtgcctgccatcgccttccagcacattccgccgcaggaattctacgattgcctcaaagaggttcccgcatggacgccgaacgcggtggaaggcgcgcgtacccacgccggccattgctacgtgctcaaccatgagatttgccggccgggatcgcggctgggtgaggcgattggctgtgcggacgagaacgtcggtgaagtggacgccttgcgtgaggcaggcggctacttcgcgctgttctgcggtcacgatcacaagaacgccttcgtgggtcacacgcatggcattgatttgggctacgcgcccacctgcggattcgaatgctacggtcccaagtcgcgctatcgcggcatccgcctgttcgaattccatgaaagcaacccggccggctacgtgacccgcatgctcacctggggtgatctggtgggccgatactccagcaacgaggtgcgcgtctggttcgaggaccactgcgtgaccggtgccatcagcatgcgtaacgaattgcgccgcccgcaggtattcgcagtgctgtccggtgccatgagcctcggttttatggccgtcatccgctcgttggtgaagaagcggtgacgaccataaaaccggtcaatacatcaattctgctgatacggcctgaatgcggaataggtggcatcctcgtcgtatagcaggttatcgggctcttccgattttggcgtgtaggggcatgtgtcagaggtgggtttggatggcgtgtctgaagccgccggcgtgcagcaggcttctggtgatgtagttgtcgaggtttgcggaatcccagggctatgcccctgagggtctcgagccttccgttgatggcctcggtgggcccgttcgcgctgtgctcccagtcgaagaacgcgaggacgtcgcccatgcgcccccacgcatagctgtaagtagtagtgctgcgtcggaacgctaagtgtgctggcgtattgtgagatgaacgggatgttggaatgggccgtcgctaggatagaggaagttatgcatgttaccaatgcgtaaacgaatatccaataagcgattgtatgaatggttcacacagtaaaggaggaacaatgggtcaggatcaatcatccgtttttgatctcgcagcggtagccgcagcgtccaatggggggaacaacgacccgctgctgcctccggcgcgattcattggcgatccgcagaagccgagtcgtatgccgtacaacaagtacgccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatgatcatcaacctgcccgccactgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgatcgacccgaaggacatcggccgtacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgtggagcacaccatgtccgtcggcaccgacgccatggccgcctcgtacgtggaatgccaggtcggcgaggccgatgacgcgcagatcgtgtggggcgtcggcatcgattcgtcgattaccaccagcgccctgaagtcgattatctccgccatcaaccgttcccagcgcaagcgctgagcgctaacagagcaaaaacaaggctccctctgattgcatcagggggagccttgttgtctgtgttttacttactactgggtgacgccgttggtgccggtgttcccgccggtgcctccggaattaccattatcgttgccggtattgttcccgttgtcaccgccggtattgttgccggcgttgccatctccgccggtagtggtgtcgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgttgctctgtcccttgcccaagccccaagtgccgtcggagccgccgatcttgccgttgtctttagcggtcgggaactgctccacctcggtgccttgcaaggcctgagccatgaactcctggaacaggtgggcggggtatccagtggaagagacgccgtatccggagaaggctggcaccacttgcggattgcccttatcgtccgggttccagatagcccacacattcatcatgctgggggtgtatcccacgaacgacgaagccatttcgtcgttggcggtaccggacttgccggcgacgggtcggcccaacatgctggatgtgccggccgccgtaccgtacgtggtggtgccctgcatggccttctgtaccaaagcgcagtcgttggcatcgaacaccttggtgccgttgctgggcgcgttgtacatgtccctattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttattcacctcttggtccaagccggtgaagtgctggtgggaattgccgttgaacaatgtatcgaagctgatgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcacggcgcaccatatccaacagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgtgccttgcccacataggatgtggtttcgcccatgtaataccgctcggcatactgctgagtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgctccgcgtaggagccgatcgcggtggtgccgtccgcgtaatacacggtggttttctcggccaacgcgaacttttcgggttgcgggacctcggtggtggtgtacaggtatgcgaatactgcgataccggccagcaagcccagtccaatcagggagaagaagatgcccagcacccatttcagtacacggtgtttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcatttatgccggtattttttccggaattcttacaattgggcacgcttcttgatgttgcatgaatattgcctgaatgcgctggttggtctgccgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgtgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcgcagcctgactcgtcgtcgaacgttgttgacccattggctgcgctcggcccggtctccggttcagatgcatcggcatccacatcaggctacttacgggatttcaggccgctggacatggacgatgcggatggggcatctgatatcgaccgcgccttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatctcctgccgctaattccgcgccttccggtcacacgatgctggccgcagcctgtgcggtgattctgctgcttaccgtgcctcgtgcggttcgagctttggcgggcgtcatcggcgtggtttgggcggtgaccgtcggtgtctccgtgatatacggacaatggcatcgcccttcggatgtggcgatgtccatcctgctggtggcgggattggccctgctcgctctggcagttacgcgcaagtccggcatggacgagccgggtcgccgcgtctcctcagtgagcgtgcaaatcgtcggcagcgtgctgattaccgggggcctgctgttgctcgcctacagcggttatgtgatctggcaggtggtgccggggctcaatgtcagcgccagctgggcggttcagggggcgaatgtcagcgctgttgtgggcattgcgggtgtggccatgctcgcattcggactgttgctggccctgcgtcagattactgcagcgcccttaagccggctgggtctgatcggcactccgccggcaccgcccaaacggtaaaacatggggtgcgaacggccgaatttgcccggcacaacggcggaatttggcagttggacatgattcatgagtattatgacgccagaaacgtcgtgtgtttcgcgcaatacataaggagtgggtatggctaccaaactggtgattgtggagtctccgaccaaggcccacaagatcggtgactacctgggcaaggggtacaccgtcatggcgtcggtcggccatatccgagacctcgcgcagcccagccaggtgcccgcggcagacaaggccaagttcggcaagttcggcgtggacgtcaacgacgggttcaagccgtattacattgtcgacggcgacaagaagcgtacggtcagcgaactcaaatcggccctgaagaacgccgatgaactctatctggcgactgatgaggatcgcgagggcgaggccatcgcgtggcacttggtgcagaccttgaaacccgaggtgccggtcaagcgcatggtgttccacgagatcaccaagaacgccatcaacgcctccctgaacaacacgcgcgatgtggatggcaatatggtcgacgcacaggagacccgccgcatcctcgaccgtctgtacggctatgagctgtcgccggtgctgtggcgcaaggtgggcccaggcctgtccgccggccgcgtgcagtccgtggccacccgcctgatcgtggaacgcgagcgcgaacgcatggcgttcaagcgcgcgccgtactgggatatcgtcgccacgctgtccgcgcctgacgcgctgggggagcgtgccgaattctccgcccgcatgatcgcgctcggcggcaagcgactcgccggctccaaggatttcggtgccgacggccagctgaccccggacgggttcgcggcgaacgttcgccagcttgatgaggctggtgccaccgccgtggcttcggcgctgaagaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgcgcggcccaaagcctgtacgagaacggctacatcacctatatgcgaaccgattcggtgacgctgtcgcaggagggcatcaccgccgcccgcaacgccgtctcctaccatttcggcgacaagttcctctccgccgagcccaagcagtacgccaccaaaaccgctggcgcgcaggaagcccacgagtgtattcgcccggcgggctcgcgcttccacgacccggacgagctggcttccaaacttcccggcgaccagctgcgcctatacacgctgatctggcagcgcacgcttgcctgccagatggctgacgccaccggttccaccgccaccgtgcgcctgtctgcgccggccggccccaccgagggcgaggccgtgttccaggcgtccggcaccgtcatcgaattccccggctttatgaaggccacgggggaggggcgcaagcccaaggccgccgctcccggcgctggggctggctcggaccaggctgctgccgccggcaagacggacgccaaggccgtcaggggtgacgcctccgaatccaacacctccctgccgccgatgagcgtcggccagcaggtcgaggcaagcgacatcgaaccggacggccatgaaacccagccgccggcccgctacaccgaggccacgctggtcaagacgctggaagccaaggagatcggtcgcccgtccacttacgcgagcattatctccacaatcatggatcgcggttacgtatacgagcgtggccgtgcgctgatccccagctggctcgccttctccgtgaccaagttgctcgagacgaacttccccaagctggtcgactaccagttcaccgccgagatggaaaacggccttgaccgcatcgcccacggcgaggaatccggccgcgactggctcacccacttctacttcggttccggcgagggcgccgcccgcaacgccgacgaggcgcacgaaggcctgcaacagcaggtcgcgcagctcggcgagatcgacgcgcgcgccatcaacaccatcgacatcggcgacggcctgcacgtgcgcgtcggccgttacggcccgtatctggaagacatggagcatctggacgccgaaggcaacccgaagcgcgcgtctctgccggacaccatcgcgccggatgagctgacggtggccgtggcccgcgatttgatcgacaaccactccggtggaccgcgcgagctgggcgttgatccggtatccggcggtaccgtcgaggtgcgcaatgggcgtttcggcccgtatgtggcgttggtgccgccggctgaggcttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtggccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgcacggtgccgcgtcagtacacgcctgaatccatcacccctgatgacgccttccgactgctcgccgaaaagcgtgcggctggtccccccacccgtggccgtcgcggtgctgggcgtgctggtggcgccaaggccgttgccggcaagggcaagaagggcggtacctcggctgcggtttcggcgcaggaggccaagcgcgccgaacgccgtgccgaagtcaagaagttggcgaacaagggctggtccaaccagcgcatcgccgaaaaactcggttccacccccgccactgtgaaaaaggacgtcgactggctgaccgccaacgagggctacgagcgccccgccgtaattcccaagcgtggctgagcggaattattgctctacttgcgtttcaaggggctgatttctcgttttgagaatatctacttccgcttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgagcggtctgtttgtttcgtttgaaggtgtcgatggcgtgggcaagaccacgcaagtcgagcggctgcatgcgtatcttgaggctcaggggcgtaccgtggtcgttacccgtgagccgggaggcactgcgttaggcaaggccattcgccaactgctgttgcacggtgtggatgggggcgccgtcgacatcgcaccgcgcgccgaggcgctgctattcgctgcagaccgagcccagcacgttgccgaaaccatccgcccggcattggagcgcggtgaagtggtgatcaccgaccgctatttagactcttccttggcctatcaggccggtggccgcgaactcacgccagaagagattcgatccttaagcatgtgggccaccaacaacctgctgcccgaccgcacgtatttgctggatatggacccagccctgtcccaccatcgcctcgaacacgcggaagaccgtatggaatcggccggtgatgacttccagtcccgcacccgccaggccttcttggacttggccgccgccgagccgaatcgtttccgcgttatcgatgcgaaccagagcattgaagcggtatgggctgccatcgaatccgacatcaaggagctcgcatgagcgtatgggattcactagtcggccaaaagccggtaatcgacatgctcagtcgtatcgcgcagggcgacccgagccagatcacccagtcgtggctgatctgtggacctcccggatcgggccgttccaacatggcccgagcattcgcggcggcgctggaaagcccggatcacggcatgagcgctgagcccacgcgcgtcacccagcaggtgcttgccggcacgcatccggatgtcacggtgctgaccacgaacaaggtgactattggtatcgatcaggtgcgtgagatcatcactacctccgagcagatgcccgccaccgcgccgtggcgcatcatcatcatcgaagacgtggatcgcatgcttgagcgcaccaccaacgtgctcttgaaagagattgaggagccggccgagcattgcatctggctactgtgcgcgcccagcgcccaggacgtgctgcccaccatccgctcgcgcacacgcatcgtgaacctcgccgtgccctccacccaggcggtggccggattcctgacctccaccaccaatgtcgagccaaaagtggcgcagcgtgcggcccgactcgccgaaggccatatcggcatcgccaagttgtacgccaccgacgaacgggttatgtccgaccgcgatgaacttgtggtcggtgtgctgaatctggcccgtgcctcggatgcagtgttgttggccggcaatcttatcgacaatgccaaggcccaggccgaggcggacgcgaaccgcatcaccgccggccaggaagcggaattccgccgcatcaacggactggcaccgagcgaccgcatcccgccgaaactgcgtggcgcattcaaccagattgccaagaaagacgatgtgaagcgtttggtcacccgccgtacgcgcgacgtattggatcgtgcgctgaactccatcgcttccatctaccgagatgtggcggtgctgcagaacaatgcggaggattcggtgggcctcatcaacctggagaaccgctcgtcgatcaccgaattgtcggtgcgattgaaccgggccggtgccgtgacccgtctggacgaagtggcccacgcccgcaagcgcctagccggcaacggcaacccgctactggtattcgagtccctcttctgcgccctgatctcataacccgacgcaactagcccccctctgatgagtgggggctgtcgagcgcagcgagactgggggagagaccccgtaacgcacagcccccagtacgtcacacatatgagcgatactgggacgtatgaagatttccgccgatttcaccgtcatcccggacgatttcgccaaggctgcggcccctgaatatttcaatggtggcgtgcctgtggtctccttcccgttctacatcgatgatgtggatcccgaggcccgctacctgcactgggagttcgtggacccggattcgattccggtctgcggcttcgagtggattcactggtccgtggccaatctgccgattgatgcgctgatgtacgacttcaatgattcgcatgcgttggccatcccgccggacttctcccgtcagctgccggccatgattcccgagaccgtgcaggggtgcaactcctcggcctccaagttcttgggccgcagcactgacccggcggtgatcatgcggtacaacggtccgcagccgccggacaaggatcatgagtactacctgcaggtgtgggccaccaagaagccgttgcccggcttgaatcagggcttctggctcaacgagctgttgcacgcgctgcgcaacagcggtgaagtgcccgacaccgacggcatcttcctgaccggcaaggcgtgagccacatgagcccccgcaggcgggggctgtcagcatcactgactgggggtgggtcagtacaaaaccaccttcagtccgacttcgtcgtccagctcccgccagtgggagcgtgaccacaacaaagaaaggacaccatcacactatggcctgcaccacgattctggtaggcaaagacgcgagctatgacggctcgaccatcatcgcccgcaacgaggattccgcgaacggcgagttcaacccgaagcgcttcatcgtcgtgaagccggaggaacagccgcgcgaatacaagtcggtgatctcccacctaaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccatcgtgctgccgtatgtcaagaccgcacgcgagggcgtccagcgcctcggcgcgctgcttgaggaattcggcacctacgagatgaacggcgtcgccttctccgactccaacgaaatctggtggctggaaactgtgggcggccatcactggattgccaagcgcgtgccggacgaggcctacgtgaccatgccgaaccagctcggtatcgacgaattcgaccttgaggacgctctgggtgaccaggaagcgcacatgtgttccgaagaccttgccgaattcatcgaaaccaaccatttggacctcgcggtggagaacactaccccgttcaacccgcgcgatgccttcggctcccactccgactccgaccacgtgtacaacaccccgcgcgcctggtacatgcagcgcttcctcaacccgtacgacgaggtgtgggacggcccggacgccgaccacaagcccacctccgacgacatcccgtgggcccgtcagcctgagcgcaaggtgaccatcgaggatatcaagtacgtgctgagctcccactaccagggcaccccgttcgatccgtacggccagctgggcgatgagcgcacccgccacatgtaccgcacgatcggcatcaaccgccagagccagctcgcggtgatgcagatccgcccgtaccgcccgcaggcctcccgcgccatccagtggatggcatacggctccaacccgttcaacacgctggtaccgttcttcccgaacgtggacaccacgcccgcctaccttgaggacaccaccacccgcgtgacgtccgagaacttctactgggccaaccgcatcatcgccgccctgtgcgatggcgccttccgctccacgtccaacgccgttgagcgctaccaggagaagaccggtgcgatgggccaccgcttggtcgccgccaccgacgagcagatcgcccgtctgggcttgacggccgccgaggaagccgcgcagtccgccgctgaagaggaatttgaggccgacaacgtggatggcgatgtgcagccgatgaccccggacgagaccatcgccgcgctgcgtaaccccgaggtgcgcgagattctcgccgccgccaaccagaccatggccgaccagctcaaggaggaaaccgaaaagctgcttgactccgtgctgtacactcgcagcatggaaatgaagaacggcttccacatgtccgacttttagtccgtattgagctcccctccctgaggggctgagccgttaagaaaacagcccagtgggctgtttttaggcgaagaggcggcgactgccgccccaccaccccgccccatcacacaaacacagaaaggctttatatgaccaccatcgaagacttcaccagccagtacggtctggtccagaagatcgacgcattcggctacatgaagtacctggccgagaaccctgacgccccgcgcaagcacggcaaggtggtgctcgtcaccgccgatacgccgctcaaggcatcgcgcggagaaggcaagaccaccacgaccatcgccctgatcgacgctctgaacaagcgcggcattgatgcgaccgccgtgctgcgtcagccgagcatgggcatcaccgcagccggttccaagggcggtgcctccggcggcggcaaggcttccctgacccaccccgagctcatcgactggggtctgtgcggcgaaatgggcgccatcgaggcggcccagaacctgctcgtctccttcgccgagaaggccatcgatgacggcaagctcgacacgattctcgtgccgcgtgtctccgaggttccgagccgctccctgcgctccaccgctgtggactacggcaagggcaacgtgccggagaaggtcgtgctcacgccgacctgcgagctcatgcagattgtggtgctctcccgctcgatggacgagatttccgagcgcgtgtccaagatgatcgccggcaccaaggacggcaaggccgtgaccttcggcgaattcgtggacctgtggcgtatcactggcattctggccgacgcggtcaagccggccaagaccgagaccgtaaacggctccccggtctacgtgcacggtggcccgttcgccaacgtgtccatcggcattccgacgctggtctccgtggaaatggcctgcgccctgcatgacgtggtcatcgtcgaggccggttacggcaccgacgccggcgcccagaagtggctggacatcgcctgccgcgaatacggcgcgcagtggccgtccgccgccatcgtggtgacccgtgcctccacctggcgcgacgatcccgagctggcctggcgctacccgttccacgtgcagcgcctggagaacctggacattccgaccttcccgctcatcaacctgtgggaaggcgaggacgatcaggttccgtccctgaaggccaccgccgacgagctgggcttccgcacgccgatcatcggcaacctgttccgcgacggcggcgaggcgctggccccgcagcttgacggtttcgtcgacgcgttgcagaacggctccatgccggccgaaccgcactcgcacaagggcatggccctgaccgagaacgccaagtgggtggccgagaacgcctacggcgtaccggccgagcgcgtgatttacaagccgggcttcaccgagtccgtgtccgaggccatggaactgtgccagagcgcaggcatctcgctggacgatctggcgttcgtggcggtcaagtccccggcgaccatgaccgacaacgaccgtgcccccgaagaagagcgcaccgtgaccctgaagaaggttgaggtgcatgccggtgccggtctggtccacgtcaacctgaccaccagcctcaccacccccatgcccaagatcgtgtgatgacaggcatgaggtgaggtaactcgcttttgaggggcggattttcggttttccggaggtctatctgcgcttcgaggggctcttcgattgcgaaatccggagtatgaccattgaaattgcaatgtttatactccggttttcttgttttaaaagccccttgaaacgctagtagagcttctgaatgttggaaatcagccccttgaaacgtagaaagcccgccaccggcgggctttctacatctgagcttccctctttgaggggagctgtcagcgaagctgactgaggggagccagcatacgcaaactagaagttgctaccctgagccgttaaacggaaagcccaccgggctttccgtaggcgatgcgagcagctatgctgcgaggggaatggtggcaactagaagttgccaccattccagccccagtcggtggtggcggtgtaacggatgtaggtgcggtcctcgggaataccgagcgtggagttcagcgcggccataatgctctcggtcagcttttcccaagcagagcccggcacagagcggccgaacacgttgacttccacataggcggcgggctggtcatcgctaccaccgaagtaaatcggcatattgtcctcgaacgggcacattagccagccctcggacttgcccggcacggcggtaatcgccttgccataggcagccttcaacgcctcgcgctgctcaggggtggtgggcacggacacatgagtgtgaataacgggcataattcctccttgattcggttcgcttccagtctagcctcagcggttgctgttgaacatggcatgcggatgtaggaagctgcttgcagaacggaccggggcaaggccaatttggggagattattggcctttccagccaatatatgttccgcagtcagcccaatagtgttgaatacccttgtgagaaaactgattgaacaactgatgaagttcggcattgtgggcgtcatcgcctttgttatcgactggggtattctcaacctattggttggcatattccacatgcacaacgtgctggctgccaccgtctctttcatcatctcgctgattttcaactatctggcgagcatgaaattcgtattcaagcatcgtgatgacatggcgcgctggatggagattcttatcttcgtggcgggcgctgtagtcggtctgttcatgaatgacgcgattatctggatttccacttatggcatgaaccatgatgcctatgtatcgcagcatgccgaatatctgttgcgcaccaatatcggcaagttggtggccactgccgtggtaatgatctggaacttcttgattcgcaagtggctgctcgacgatacgcacaccaatgcgatgaaccgtctgaagtccgctgaaaatcgactgaatgccgaggagcttgaagccaagtggcagaacagcttctcccacaagctcggcatctggtccctggaacacacgcccaaaggctggccgaagtagcgttttgacgtataagccccctcgtcagagggggcttagcttttgtctcacacactcacttcagtcaaggtcggctgctcggtggagcccttgatctgcttgaagccaatcagcgcaatcaccagcgagaccagtgccaaagtggtcaccaccatgaagccgccatgcgagcccatgcggtcgatgaactggccggcaatcgccgaaccggcggaggagccgatagaattcatcgcacccatccacgccatgccttcggtcaggcgggaaggcggcaccaagtgcagcatgagctggttgccgttaatccacgtcggagcctggcacacgccgatgatcaggtagatgatcataatcacccacagatgcttggcgaacaggaacgtgctgatgccgatgttcaccacggccaggcagaagtagaagcgcttccacagggcaatcgaccagttcttcgcgccgtacaccaaggcgcccatcaacgagctgatggagaagcaggcgaatacaaagcccgtgtactgcttcatattcgactcggtggcgaatgcgatgatcgagatgcctgtagccgactggaacgcgcccaagccgaaccaggtgacgcataccgcaatcagacccggtccccagatggacgccttcttgccggaacgcgcatcggcgaccgcctgctcaatggcggcgttaatcgtggcctcatcggtcacgccttcgcgctcaagacggcggcgagtctcctcggctgcggtctccaccttcaacgcttcggctcgagccgcctcgcgctcacggtattccttgcgggaaatgccctcagcgcgggccagctgagtctgtgacggtggctcagtggtcagctcggtcaagaacatcagcgcgcccaccaccacgcacatgccggtgaacgagaatgccagcagaccggagatcacggccagtgtggaagccagtggattgccgattacccacatgcattcgtccagcacgccgcacagggagagcgcacggttggtacgctcctgatcgcccttcaggattttggtccagcgcgcgcggctcatcgcgccccacggcggaatagctgccaggaacggcgtcaaacagtacagcacccattccggcgcacgattggtgatggatgtggtcagcgcgacggcggcgacaatccacaccagaatcgttggaatcgaaacctgccgctggccgaacttgtcggtcagcttgccgagcagcggcgtggccacggccagtgcaatcgcctgaatggcggtgagcatacctgccagcgagtagttgccgtagtaatgctgcacggaaatggtgatggtcatgcccaccatcgggaacggcatgcaggcaatcaccgaaccgatggaataacgagcggtatgaggtatgcgcagcaactccgcatacccaccaaaaactttgtgacccacttccttgatgccagccataatggtgttcgagttggacaggttgttggacataacagcactacgctcctttccgctcccgattggatgttccccgctgacgtggcgttgccggcgaagccctcatcgaatgatgtgttgtccatggtcgcgcaaagtttgcgttggatttccctattcgcatatttgcgtcacggatactctaatcgttggttagggcgcgacacgcggtagattggagatattaagacaacgttctcatgttcttcggcgaacatcgcaagatgcccgtaggaataaaaagaaaggcggctcatgagcgcaaccaccatccacttcgttcgccacggcaaggtctacaaccctgaccatctgctctatgagcggctgcccgacttccatctctccgatcttggccggcgtatggcacaggccaccgccgcctatctggccaatagccctcagaccaatatgatttccgcggtgtattcgtctcccctggaccgcacgcgcgagaccgccgacgcgattcttgacgcgttgaatcccgtgcgcgaggcccgaggcgaagccccgctcatgctcaccgccgatgagcgagtgattgaggccggcaacgagttccgcggcaagcgtatcggccatggcgaaggcgcgctgtggaagaacggcaattggaaactggtcaccaacctgtacaagccgagttggggcgaatcctatcagcacattgcgcagcgcatggatgatttcgcacgcgagaaggtcgcccaacaccccggcgaacagattgtggtggtcagccacgaatcgccgattttcagttatcgccattatctggagaccggccaccccgagcactggatgttcctgcggcacacggcgctcgcctccgtgacctcggtgacgtacgacaacgaaaccggccgtgtgatgtcaatcacgtatgtcgacccagcagccaacgtcaagtaacggcacactggtgaatagctgagctacaatctgggctcccctcagagggagccaatgggacgcactacaatcaagtggtgaacgcagaggagcatgaatgaccattgaactcaatcgtgaggcaatcgcacggatcgcggcattgccgggggtagctgaggccgctgaagccggctcggcgctaattagcctgtggccgctgaccgaagccatgcagatggacaatgacgccaagtatgcggagaacctgcaggtgcgtgtcacgcacgcgttcgcacgcattctcaccggtcaggatgttacgatgcctgacgccgaattcgtctacgagggggccgatgagattcctggccgtccgcaaagcatcgtagacacgctgcttgctgccaatgacgcctacgatacgatggccggttactcggaatccggcgatgtgcagctgattttcgatgccgccgaagctttaggtgttgactgggattcgcatgtcgaggccgcagtccgtgagacggttgtctccgtggaggctcaggttgaggccgatgccgaggttggcggacgtttggcggcttccggcgagccggctgatgtggccgtccgtttcgccaccgcgctcgccgtatgcgatgcgctgctgaacgtggtgagcgggcatgccgagacggttggcttggttggtccggctgttgctgatgccgctgatgttgctgacgaggcccgggccaccgccatcgtaacgttgccgattctgctgtacgtcaacgaattacgtgagcagtgctcgattccgcgcatctgcctgaccgaccagcagattcttgatctgattgatacgcgtgccaatgccggtgacaccctgaccgccaccgccgaatacattgccccgctggccggtgccgaatggaccaagcaccgcgacgatgtgctctggaacccggacgaagccaagaagaaggccaaggaagaagacgaaaagcgcaacaaggaggccttggccgccaagtttgcgcacattaaagatgaccctggcaaagaaaccgtggagttgtgagaatcaaggcagcttagcccgcctgatcggttctcttacccctgctcgcgattcctccgtgccaaggaaatcgtctatgtggtgaagaacatcgcttacgcaacggaagaagaaacacttatgggcaatggcgtcaatctgcgcacgctcaccaatgacggcggtagcgcggtaatcagcgattacggggcgcatctgctgcgctgggccccggcggggcagccggatgtaatctggacgccccgcacatggcatttcgaagctggtcagccggttggcgggggagtgccggtgtgcttcccctggttcgggccggggtttgtgcatggcgggcagactgcgaagcgaccgattcatgggttcgcacgattgcgccagtgggcgctggacgaaggggcgtttaccggtgcccgtgtgcggtatgtgctggattccgaacgactgacgactggcgaagtgccatggatcgaggatgaacccaacgtgcgtttccatgccgcatacgaggtgtgtgccagcgatacgctgacgatgacgctgaccgttaccaacacgggaggtgagccgatgtcgtatgaggcggcgctgcactcgtatctgcatgtcggcgatgtgctcggcgcgcggctggtcggtttgcggggtgcaacatatctggatgccacggaagccggattcccgccaaaactacaagaacagccatcggtgatgttcggcgatcagccggtggaccgtgtgtattattccgatgctgcactggaattgcaggaccatgtgctgggtcgtgtgattcgcatcggcaagaccggctcgccgcagacggtggtgtggaatcccggagagcagggcggcaacgccattgcccatgccaagacgggtgaatggcgtggctttgtggccgtggaggcagcggcgtgccgagaccgtatcgttgcccttagtccgggtgaatcgtatatgctttcgcagtccattgccgtgatgccgttggggtagttggctgaatacagtgccgataatacagtgccgagaatgatgaagccctactcgcgttgagtagggcttcatcattggttgcggggaacttcttcaacggaagttcaccgatatcggttactggccttgccagggtttctgggcattgtcgccggcgggagccgtgtgctcagaaggtgttgcggattcgtcgccggcgttttgaggcatcggcggaacctggccgtactgtggggccggggcctccggttggccgtactgcggggccggcacctgaccgtaatcaggtgcgggtgcagccggctggccatagtcgggggttggcatgggcggctggccgtaagccggggccggctggttgaagccgggtgcgggcgcgttcggagcggcgaaattcgggggtacaggcgtgctgtatggtgcgccgtaagcaccctgaggcatgggggttgccgccgcgccatcgtcaaaacgtgcgccctccggcttgctgggaagagccatgaacacgatatagacaacgcagccggccagcgtaatcaacgcaccaatgaccgccgcgccaagaccgccggcggccatgctgccataaccatagtcataactgccaaggctcctgaacccgccgtacagtgccgcaccaccgccgataatcatgatgataaggccgataaccatcgcgatatagaaaatggcaacccaccagccaggcttgttcgtgtcatgcagacggcggacggaaagtgccagggtggggattagggtcgccagaccccaaatggtggcgaggaagccaagcttttcatctgtggcggtgttgaggatgtccagcacgatattgatgccgaaagcggccagcacccaccaccagaattcactgcgggacgcgcggcccttgaacaccgtgtacttcttccagaagcgcaggaaggcttcttggaaggagcatccgtagtaaggcttatccagcggcacagtggcagtgggcgcggcgtattggccgtaagacggcggaaccgggccgtaaggattgccatcgggggtcggtgtgccgtacgccggtgcggattgaccgtaggtgttggcgtcgggcgcgggctgaccgtaggttggtacggcctggccataagagttcgcggtcggagcagactggccgtatgccggctgtccgtaagcgggctgcgccggctgtgagggctgcgccggggccggtgcgccatactgcggtacgggattaggtgtgggcgtaccgttggcctcaggctgctgaggcaaaggcacattgttgggatcagacattgattcccctttcataagacctatgtgtcacatcatattcttccattgcatgagtggaaaactcaacaattgcgccaaataatgtccaaagttgtggtgaatgcactggaaagaatcgatggttatcaaatcgatatcagttgagggtgaacgttatcgatcggttgtgtaacctgttgcatgaatattgcgcacagttgcgggggtggaactggaaagcagacgaagcttttggcgctatgcataaagcaacatacagagatgtagggaatgccatgaaccacgaatacacggatgccgccgttgagcagcgcgaatcgcatgaagacgaatctcaagactgggatctgctgttcgtgggcctggcctgctgattctcgtttgctgttttcttttcttttgattttgcttttaaaagaaaagcaaatggcaggcaaaagagatttcgttggaaaatggccgttttgggatggtgttggcccgaaacatcaataacgaagcaaaagagcgaggagcgctgctctccgcgtccggcgcgcgcggcacaataggggactatgactgatgctgaaaacaccaaacccgaactgcccaagaacgttcgtgttcgcttctgcccgtcgccgaccggaaccccgcatgtcggcatgattcgtaccgccctgttcaactgggcggaagctcgcgccaccggcggcacgctgatcttccgtatcgaagacaccgacgccgtgcgcgactccgaagaaagctacaaccagatcctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccactcctgaggaaatcaaggagcgcaaccttgccgccggccgtccggccgagttcggctacgatggctacgaccgcaacctgaccgatgaacagaaggccgccttccgcgccgagggccgcaagcctgcgctacgtatcaagatgcctgatgaagacatcgcctttgacgatctgattcgtggcaccatcgagttcaaggccggctccgtgccggactacgtgatcgtgcgcccgaacggcgacccactgtacacgctgaccaacccggtcgacgacgcgatgatggaagtcaacgtcgtgctgcgcggcgaggacctcctgagctccaccccgcgccagatcgtgctttaccgttaccttatggaactcggcatcgccaaggagatgccgctgttcggccacatgccgtacgtgatgggccagggcaacaagaagctctccaagcgcgacccagagtccaacctgttcaaccaccgcgacaatggcttcatccgcgagggcctgctcaactacctggccctgctcggctggtccattgcaccggaccgcgacgtgttctccatggacgagatgaccgagaagttcgacgtgcgcgacgtcaaggccaacccggcccgcttcgacatcgacaaggccatctccatcaacgccgagcacatccgtatgcttgagcccgaggacttcctgcgccgctcggtgccgtacctgcaccgcgacggtgtggtttccgccgacaactgggatgccctgaccgaccgtgagcgtgaggtgctgaccgccgccgctccgctggttcagccgcgcgtgcgcctgctgggtgaggttgccggcatggtcggctccctgctctccaccgagggctacttggagccggctgacgacgccaagaagcagctgaaggattctgccggcgaggtgctggacaaggccatcgccgcactcgaggctgtggatgaggctgactggaagaccgacaacctgcatgagaccctgaacaaggctctggttgaggagggcggctacaagccgcgcctcgctttcggtccggtgcgtgtggccatgtctggtcgtcgcgtgagcccgccgctgttcgagtccatggagatcgtcggcaagccggtttccctcgctcgcctgaagggcctgcgcgagcacctgtgagctaaggttccttccgtgctcggctgagctgtaaggacactcaaggtgggcgtctgcatgtgcagatgcccaccttttcttgtattcagtgatgagctggaacagctggaaagtcttaccgctgcgccgcatgccagtgagaatatgtacgaggttgaacatggctggtttgtgcagtgaggtcacgaaacgtgccttgtaggtggtttcgccttcatgcgtccatgaaacggttgataggtaaccgggcggcggtctttgacgtgacattgcattacaagcatcgcgacgcgctcgctgtcgcaagggaacataagcgcctcatttggttcttgaaggctgatttgccggctatgaatgtgcaaggcaaagatcattgcctcatctgcaatttcatcagtgcattagatggtaattcatcagtagtgcttactgataatccgtcagtagagttcatgcaaattcatcagtagtggcagcgtagcacttgaaatcgttgaaattccgcgcgacacgccgtaagttgcgtaagggtgaatacttgcgtatatttatcactcgttgcgcggttcaccgagcagccggttgaaaaactgaatatgcccccatcgtctagcggtctaggactacgccctctcacggcgccaacaccggttcaaatccggttgggggtacgacgaacaactccttggagttgctacgccaagccaaattgggatgtggtgtaattggcaacacagctgattctggttcagccattcttggttcgagtccaggcatcccagccaatgaccctcgcggaatgcgagggttttttgttttcagggaagtagccgcttgaaaagcgacttccctgcatatgagtgcgcataagagcgctaagagcgcatacgtgtgtatgaaagtacgagaacgaaggagatcgaagtatgtccgctgggcagcaggctgtaccggcaaacaacgccaacaatgcaagcaatgaaggcgctcagaagaagcacatgtctaaggcggccgtcgccattatcgccgtggtggtcgtggccattatcgtcgtggccggtgtgttcggcttccgcgcctactccgatgctcagtacaacaatgcagtcgccacttgcgccgccgcttccgaaaatgtgcgcaacgccactaatgactacaacaacttggtcaatggcgatgcttccgaagctgctgcgctcaccaagaaggatgtaaaggatgcctccacgctggacgccctcaacaaggaactgagcgtggaactgccggtatacgaaggctgcgtagctgacgacactgccggcttcaagtccgctactgcgaagctcaacgagcaggctgattggtacaaggcttatactcaatcgctgcagaaggctgtggatgccgtgaacgcttccaagaagtaagcgagcacagcctcaccattgtcgtcaaagccgtcttgcggttgcgcaaggcggcttttgctattttgctcaatcggcttgctgctgtaatgctgctgcattgattgcgtcgaatgcaggtaaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgctattaagaatagcttcttgtaaagtgtcttatcgtaattgcgaatgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcagtgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctctaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaacgacccgggcagcggcctgttcatcggctacgattcggacggctggttctggcagacctacaccggtggcggtagcggcagctggtacagcggtgctcgtatcgctgctccgagcgccaacgaagagcacgacattcaggtctcctggaccgacgccgaggtcgccacactgaccgtggatggccagaaggcattcgatgtcgattactccgcaatgacgaacctctccaacaagcttgccatcaaggccggctcctggaaggggctgaaccaggtcaccgacgtgtacatcaaggacttcccggaggttgtcgaagccgccaagcacgcggtttccggcaaggttgtggacgctgaaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtgacggtctccggcgcggatcttgccatcgatcccatcaccctgaacaaaaccgttcaggtcgcctccgaaacgctgaagaccaagaagatggaagttcagattaagaagaacttcccctctgtgctgcagtacacgatgaccgacggcaaggtgatgtacggccagtccaaggatgtgcgcaccgttgaaatcaacggcaccaacatcgaactgggcgatgacgacgtgaccttcaagaaggtttccgacaccgaggccacctacacgctgaaggtcaaggatgaggccaagaagattgacgcggtgatcaccgttcagatcacggtcaaggccaaccagctgcatctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacggcaacgttgtagtagtctcccgtggttccaacgacacctctagcgcagcctaccgccagcgcaccatcaccttcaacggcgtgatggtggcttccggtgctgtctccgcaggcgatggttcctccactggtgacgagtcctacctgctgccgtggctgtgggactcctccaccggcaagctggtcaaggattccgaacagaagctctaccactggaataccaagggtggcaccaccacttggaccctgccggacagctggaagaacctctccagtgtgaaggtgtaccagctcaccgatcagggtaagaccaacgagcagaccgttgccgtctccggcggcaaggtgacgctcaccgctgatgccgaaaccccgtacgtggtgtacaagggcgaggccaagcagattcaggtcaactggagcgaaggcatgcacgttgtggatgctggcttcaacggcggctccaacaccctcaccgacaactggaccgtcagcggctccggcaaggctgaagtcgaaggcgataacaacgccatgctgcgcctgaccggcaaggttgacgtctcccagcgcctggccgaccttaaggccggccagaagtacgcactgtacgtcggcgttgacaaccgcagcaccggcgacgcatccgtcaccgtaaccagcggcggtaaggtgctggccaccaactccaccggtaagtccatcgccaagaactacatcaaggcatacggccacaacacgaacagcgatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatgcaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccaatctggcacaggatggcaacgacagcacccactggcacaccagctggagcgagaacgcagtcggcaacggcaccgcatggtatcagttcaacctcaacgaaccgaccaccatcaacggcctgcgctacctgccgcgctccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtccggtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctgccaccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaggctctcgagaaggcaattgccggcttggtgaagcgtcccgctgccaagggtgatggcaatgtcgtctccaacacgggtgccaatgtcgtcacgattgctgtggccggattgctgctggccggtgccggcgccgcaatcgcctaccgccgcaatcgcgagcagatgtgatcatgaaaccgtaaggttcgcgaccacataaggagcactccttattatctcggccggtgccggtcagcaatgcccagcgccggccgtttttgtatgaatcagtgttttccggtcacccagcgggcatcggaatgcacatgggggatcatcatcacaatgaccgcaatcagacagacgatcatcaccatcaaaataacgtcctcatgaccgcgcgtctgcagcgtggctccagtcaaagcaccgagcgccaaagccagcattacaatcgcgcgccggccaagtttggactgctcatgaccatgcgccgaagtgtcagcgataatcccagttaacgtcatcgtcaacacagtcgtgggcaaatctggcaccgaaagcttacgagcagtggaattctgaatgcccatagccggtgcgagcagcacaatcagcagaataatatgcaaatcaatatgccgagcagttgggaagttcagactgggctgtgccgtgcgggcgatggctgaagcatcagtgccacccatcgacggttcaggcgcaaactgattgagcagataaatgccgacgagcgcagctgccacaaaagccagctggattgacgtggacaccagcagatggcgcgcgcggttggcgccaaagtaatgaataatgcgtccgccgatgaacgcaccaatcatgaacgtggccagcgtgagcgccgaagtccaccagacgaagccctgcgcgtgggcgaatgcaaaaccaaggaacacaatgttgccggtcacattggccacaaatacatgaccgagtgccaagtaacttaacgcatccaccagtccggcgacaaacgtgagaataaccagagctggggaaagcagaccgtaccgatcatccttgcggggaatcagtgtgcgtcctgcttcggcaaggtgtgaggtcatggtgggagaggctttcctttgctgtttggcggtattcaatagctggcgcgcggccttgcacattatgaagtgtgtgccggacggtatatgtcaatgagtctgcgctcgcatgcggagtgcgtgcaacagttcgctatgagttcacctgcgattcgctgaacgcgcatagttcggtaacgcgatttcgctatatctggtcgtaataccgatgaggctaggaaaaggaatgattatgcagtcagataacagccatcatgaagcacatcagaacgacctgaactacagcagtgagtaccagtacgatatgtatatgtatgccgagtacggcatcgagtggtgattgagagccccgagtgagaattggactcacgacctcttccttaccaaggaagtgctctaccactgagctatcggggcgataatgtgcgcacggcttagggccgttgaacggcttgcacaacaatacacgcaatcgcgtattacgcaaatcgacgggtgtgcgaggaagtattcgggtgctctaagttgtacacatgagcgcaatattggctattttgcgctcatgtggcattcggatgtgccacgtaatcgcattttcgtgtttttatgcgctgttgtggcacgaaaattgtgggaattcggtcgtctcggaatatgtgccatgccacgccactgcaaaaacagtgaatgtgcacgattgtgcacatatttggaccgctgcgtatatgcatgtgggtgcggataacaaaagggttttgacaaaagccaaaaccctgatggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtgggcaaggaccaccaatgagtgcctgcgctgatgtgcaggtcgttcgtacggcgtgtgcaacaggtgatctcaccgggggatgaaccagtgcaaatcaaagcgactcaaggcaagtcagcaaacccgaggcaaaccagaatgaacatgcgcatgccatcgcgtgaattattgccagcctcttgccgtgatgcaacatagtgattttaggctatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctagtacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagcgttgactacgccacctgggccgaagtctccaaggcgatggacaagcagctgaacagcggtcttaagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgtcgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaatagcaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagagggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttggcccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgcgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggatgcggtcgtttccgacctgtacaacaccgagtcgggcggcgcgacgtccaccagcgacccgaccgcttttctgaaggagtcggacgcggccaagatcaagacgatcttctggtcgttcaacatcaccagcttcgcgccgcagctcaacatccacgccacggtgaacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgtgaccaccggcgacaccatcaccctcaacaaaaccaccgcctcaggcaagaagaacgagcagaaaatcaagctcaccggtgtctacgattccggcgacgaggacaacggctcgctctacatcgcctcctccacggcccaggtactcgccgacctgcccgattcggtcgacaaaatcgaggtcaaggccctgaccacgccggagaacgacctggcccgtaaggccgccgcgaacccggccgcgctgagccaggaggaatgggagacctggtactgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgaccgtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgtctggcgatgatctgcctcgccgtgccgcagcagatgaacgaggagatgcgtgcgtacggcgcgaacctgattgtcacgcccaccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgtgatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggctaccgtgcatccgataacgccagcaccaacggcacttcgtcgaactcctcgatcgaccagcaaaccaaagacggccgtgtctccagtgacatcatggacacctccggtaccgaattccgcgtggccggcatcgtggacaccggcggcagcgaagactcgatcatctacgccaccaacgccgacgtcaacaagctcaccggcatcacgcgcggcgtggacgtcatcgagtattcggccggcgccagcgacctcgcaggcctggtgtccagcatcaacgacatgacctccatgcacgtcaaggcacagcaggtcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgctagctcgcgtgccatcggcaccgagttctacatcgaatcgtcgctctacggcctgattggcggcctcatcggcaccgcaatcggctacggactcgccagttggctgtgcgtggcggtgttcgaacgctccatcgtattcaactggtggctggccctgatttccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcgtgccgtggacgacctcaatctgaccgtgccggaaggcgaatggctcgccatcgtcggctcctccggctcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcactgaccccaccaaggccgcgaaaaccggcggcgaggagtagggccgtcaggggcatcgagcagtatgtgaggaatacatggcaagctgatggtctctcccccagtcagcttcgctgacagccccctcgtcagagggggggcttaaggagcgtgaatatgaccgaaaagagtacgttgaagaaatccgcgacattggcggcggccggactggtcgtggctggcgcgctgctggccggatgcggcgaatccaaggccgcgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggtctcaaagtggacaaggtcgccggcgccagctggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagatccgataatcgtggacaacagcaacttctcgtcaacgtcctcgcgaaacacgccctgcgcgactccctgcttgaggaacgcccccacacgctccagccacggggtcaccacttggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgtgcagcagctcgtcggcattatgatatcggcggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtgtctgtcatctccgtcatctcttctcttcgaaatatgctcccgtacgctcccgctggcgagagctggctggcaaagccagactgagggtggtaagtccatgccgtttgtaggcaactcccggataatacctactagctcagcactttagtgctctcgacttgggctacataccactggttgaaccgcaccagtggcttcctgagcaacagcccaagcaacagtagcggcggcacgaatgccagcagcattccggcggcccgccagtaatccatgtcgtagatgccggcgatggccgcacgcatcatcgtcaccgcatgggtgagcggcaagagcggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcaaatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcgccggcggaacgcagtttgccggacaccttgtctaaggtagtgcgagcgtcgctgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgcgcttgatcagccagattcttgacctgcgcatgctgatcctgcgcgtcctgattgccttggcgaatatcggtcgccgccgtattcagcgcttgccgcagcctgttttgtcgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcgaccgtggtggcaccatcattcgcgtcggaatacagcttgtctatggaatcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgattagtgagttcgaggtgtcgagcaaggcgccggccgtatcggtcaatgcgctgtatgtgccaagcagatccgcagtatcgtcaagctgtgtggcgaaattggcgatgttggcgttgaaggtattcagttgctctttggcctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggtcggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacagcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgactacgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcagatgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccaggccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggcctcggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttttgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccggcaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgccgctgcccagcggcttatcgtgtgtcgctgggcagagcgaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactaccctcggcaagccgcgggagaaccgtgacgccgagtccgcagtcgtggccgatctggtggccgtcgaactggacgaagccggcttgaacctgaacaccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgttcggcgtgatgctgctgcgcaatcatcgccggtatgccgcgcgctggacctacgtgctgatgccgttgacgttggccgacggcatgctgtcgctggccctgaccggccttggcttcaacctgctgctgccgctgattcagatgattattctcgtcgtgatttcggtgaccgccgatccctccctgagcgaggaacgccgtctgcggcgcgcgctcaggcgtatggacgatcgcgatgattatgaatcggctgtggcggccggcatgctaggccgcgaccagtccggcaagggctatattgcgctggacttcttcaatatcttctggctgtttaccatcgcttcggtgggtggcctgattgtggagacgatctaccatatggcgctgtataacggtgaacttcaggaccgcgctggtttgctgtggggcccgttctcaccgatttacggctgtggtgcggtattggtaaccgtgtgcctgaatcgcctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtgggtcaagtggctgttaccgcgactgctggctctgattaatcgcattccatggaaagtgcggtattcgctgactgcggtatgcacggtgctgatggtgatcgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggccggcaagtaattacgcttcgcgggcagaaggtgcgtagaacctaagacagccctcgcgtgtgggtggtaagcgggatacactttcaagcgttgaaggaatgattccctccgctgatgcgctgttttgtgacgcgcgtgatgacgatggggacaatcaaacgaaaggcaaggcacatggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtgcgtgccaagggcttccacttcgtgggttgcggcgtgtccggtggtgaggaaggcgcgctcaacggcccgtctctgatgcctggtggcacggcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgatcttgattcctacctgatcgagatcaccgctgagattctgcaccacaaggatgccgagaccggcaagccgttcgtggacgtggtcgtggatcacgccggcatgaagggtactggtacttggaccgtgcaggctggtctggaatttggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggccctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgtgtaatcgtgcgtgccgtggaggccggtatcccgaccccggtgttctccagctccctggcgtactacgatggtctgcgctccaagcgcctgcccaccgctctgacccagtcccagcgtgacttcttcggtgcccacacctacggccgcgtagacaagcccggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagcccgagatcgaggcggctatgccgccgagccaacactgagcctcgccgcaggcgagtccctaattgcaggggccggcggcgaagaaggcaagcccgagatcgaggcgtagccatagacgaattaagccccctcatcagagggggcttaattcactcacaactcggtgacggtttcttcggtggagaaccagatgaactcgtccactccgttggcgtaggaggacgggtaatccgggttgttgggctgctcgaagacatgggccagcgattcggctttgccggcaccggcggcgaagaaccacgtatggcgtgaacgcgcgatgagcggagcggtcaatgaaacacgcagcggcggcatcttgggggagtggttcacacccacggtgagcctatcggtaaccttgacctcatcatgaccagggaacagcgacgcatagtgaccgtccggtcccatgccgagaatcatcagatcgattaccggttccggtcccaattcattcaccaactcgcgctcatagtcgctcgcgacatcgtccagcaacgcatcattcgtggcatcggcggcggcgcgaacggaagcatcatcgctgtcggcctgatccatcacatcggcgatgtcgtcggctgaacgggtatcggccgccatctcatgaatattcgattcaggcagcttgccatctgccaccagctggtcaagcagcaggcgacgggcctccagagcattgcgatcggtgtcgtaagccggcacaaaacgttcgtcgctccaccagaaatgcacgcgtgaccaatcaatcgcatcagccagcggatcgctcagcaccaagcccaacggctgcgcggccgaacctccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacgcataatacgggtggcatgccgggaatctagccatttgcagcaatgaaatgtgttgtcagttgacaacacaatgtacattgtgcgacatcacatatgtcactttattactccgcgggcatgagcttcggcatcgcatgaggtaggaaacgatgagcaacggcgttggcatggctcggccacaattgccgaactcatgccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccaagtttcagacgcagccatgcgcacagcatttccagaggcaggaagtcggccttgccggtcaccttcacggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagatgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgaccacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcactggccagatcatggccgaacggcttctcgatgatcacgcggcgccatgcgccctcggacgagcgcgacaggccggaggcggccaactgcttggcaacctgtgggaaggcgcgcggcggcaccgacatgtagaaggcatggttaccctgcgtgccgcggtcgcggtcaagctcctgcacggtggcgctcagacgctcgaaggcctccgggtcgtcgaacgtaccctgcacgaagcggatgccggcggccagattgcgccaagttgactccttgaacggcgtacggcaatgcgcctggacggcggccttgacgaattcgatgaaccgttcctgtgtccagtcgcggcgggcgaagccggtcagaccgaagctcggcggcagtaggccacggttcgccaggtcgtagacggccggcagcagtttcttttgtgccagatcgcccgtgacaccgaaaatgacgaggctgcatgggccggcgatacggggcagtctgaggtcgcgcgagtcgcgcaggggattgctccaatttggggattcactcataatgtacaagggtagtcgccggcggctatctatcgctagaggcgatatgcgatttgggctgcgatttgggccacattgcgtgtgctgtgccgtgcgttgggccaatcgcgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatccttggaatcgcaatggttccaaggattttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactgccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaacgattatcaggccgagcagcccggcggtatcggtgaggaagacatcatcacccttgtgctgccgtacgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgatgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggcacgccgtacgacccgtacggcacgaccggcacggcggaatcgcgccaccgttaccgtccgatcggcgtgaaccgcaccggccatatggtggcgattcaggtccgtccgtatgtgccggcggccaatcgcacggtgatgtgggtatcgttcggctctggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcacactggtatgagacgaaccggttcatcgaagggtatgccgagggcgtgcgcgcgttcggacaccggctcatcgagcgcacggatgagcagttgcttgctcgaagcgatgccgaatcgacggatacgaatgcatggccgctcgatggcggccacggcgatgagaaggatgtgcagggcgtggcggatgtgctcgaagcggccaacgacgagatggccgactacctgcgcgagcacacaaccaagctgctgaacgacgtgctatacacctccagcaacctgatgcacaacagcttcgcgatgtccgaccgttgggccgagtagcaaaacctcgactggggaggtaatagggatgccctgctgataacgcgtcagcagggcaaaaccacaatccgaatcagttaaagccgacgatgcgttcggcgatgagatagccgttgcgcacgatccagcggccggttttgccgggcagattgagcgcgcgggacatcagctgcgagcgcacatccttgccgatggccggcgaataggcgtcaatcgcatcccacagctcggttttcttaacgtagttggccggatcgcgcgagagaatcaggaacgtcgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtgtgctccggcagcttcagcccggaatcgcgcaccacctgcgtgcggaaggtgagcgcatgcatgatgatgtactgcgccagaccgaacttgcccaggtcatcccagccgagcacgcggccggcctccattacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgcacggcgcccggattggtgcgttccagcttgcgcgcgtactccagcgtgccgtctttcgaaccgtcgtccacaatcagcacctcgaggtcgctgatgtcgcttgccgaaagcagcgagttcacgcaacggtcaaggtaggactccatattgtatgcggggatcacaaaggtgagcgtctttgccgtgctggccatgaaagtcttacgtcctcacatatttagtcgttatgttcagtttcctgttcaaaccgtagcacttcgcctcccgactcggcagagtgttgcgtaacctgtgcccctgaacgcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcagccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcgagcgcggcggtcagcgtaccggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgccgggtggaattgtcggcctgagactgccgaattcgtaggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtggtcagcgtgcagaaggagctcggcgtgccggtcaagctcgtcggtcttggtgaaggtccggacgatttggcacctttcgatcccgaaggtttcgtggacggcattctcgcgtagacggtcgagttcttctcagtctcgctttgctcgacagctcccctcagcgaggggagccctgcgtccgtccacgttgtgggcgcgggaaacgcccgcaacgcaccaaacctagccccgaagcatattcgaaacatgattcggggctttcccatatccgttggaatcatgccggaatcagcccatccgatgccaacctaattgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattatctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgttgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgctgaaacgctggtcggtgtgatcatcaagtccgccggcaccggcaccatcggtgacggcaaggtgtgggtcgctccgctggactccgtggcccgtgtgcgtaccggtgagaccggttccgccgcgatctgataacacagacgtccatgcttagaaggggatggactgcataggaaaggtccccgcacgccgcgaattgacgccgtgcggggactttttttggcaatgaaagatgaagcaatgacttcagcagtagatggcttgaaacaacgattcatggatatgagccagccggatgacgacggcgtctaccggaatggtgcgaccaagcgcaaagcccgcacggaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgacatcaaagaggcccgtggggggttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatctgcagacactgcttgcccgtatcggtcggcgcatctccttctcgcttgattccaccgcttcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggcgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtatcacccacgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgcagcccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccatcaatgcctgcctgcagtccctcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgttgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgacctgcgtgaatccggctcaatcgaacaggacgccgacgtggtgttcctggtccaccgccctgacttctacgacaaggaagaccgccccggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccgctatttcccgtccgatgacgacatggccacgaccgtgtcggtggaaggtgtggccgggccgctcccctcagccagaactcccctcagtccgcgaagcgaactgagaggagcttccgcaggcacggcagaacttcccgccgacgtgacacttaccgcagtgggcgaccacaaggccaccttccagatggacggtcagggctacgccaccgacgtcaagcttgaaggcgtctacaacctgtacaacgcggccgccgcgctcgccgtggtacgtgcggtgatgcaagacaatgccgccgcatccaaggccaccgccgcagccaacgcctgcgccgtgtccgccgacgagctcatcgccgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgtgccgtactgggccgcatcaccgaagtacgggacgcgggcgtgggcaagtaactatcctctagcgcccgcgcgccacctcccgcctgcgggaggacatggtgaggaataagacgcttcccgtcagcgggaagacatcgacaaggagaacgtgacatggccagaacaattgatgtggtgtccctgtatcccaaagacatgaacatctacggcgattccggcaacgtgctgactatccgccgccgtctggaactgtacggttatgaaccggtcgtccaccagtacaatcaaggcgacgactggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcaatcaggacggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgccgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggctattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggcgtacaccgaactgtgcaccgagcatgtggtggtcatggagtacatcgacggcatctccgtctcccatccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcaccgtggatctggtcgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggctctgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattgatatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccattttccgtaccggattggcccggccggttcgatgcctagctcagccagtgcctcgaccgcacccttggtgcggtcggtggcagcggtataggtttcgtcgccgccgataatggcgatgtgccggcggccgcaagaaatgagatggttgatggccatgcgaccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatggtgccagtagtgccgcgggctagggattgggcgagcttgttgggagagtagttgagttgcttggcggcatccagtacacgctgcttggtttcttcgctgatgcggggtttgttgtgcagtgccttggatgcagtggccgtcgagactccggccaatgccgccacatcctcaagtcgcgctgcccgtccggttgctggctgggtcatcatgcctcgattccttggttcttcagcagtatatagcgcattgttttgcgatgaaatacctcatacggtgtggtgcgccattacatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgttcgtttatattgagaaaaggctttcgcagtgttacctgctccgagcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggataacaaggccgacctgcagcagggccacatcgaagccggtactgttgacggcgccgagtacaccctgccgttcatcaccgatgtttccgtgatggtctggaacaagaacctgtacaaggaagccggtctggacccggagcagggcccgaagtccatcgctgagttcaccgagcaggccaagaaggtcgccgccctcaacaaggatggcgtcgcaggctcctaccttgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggcgttatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttttcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgattgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggcctgatgcaggagggtggttcggtgctggccaccggccagtcggccctgtgggccacgattatcgtgattgtttggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccttggtcatcatcaactccatccagatgcgcggcatgcgcgacaacaccaagtgagaaaggggaggtaacacattatgactaccccattgtggaagcgtatcatcgcccggatccttgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgcaacgcgttcgacgcgatccccaaggacatggaggaggccgccatggtcgacggctgcaacagcctccaggccttgttcaagatcctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggccggagctgtcaagggctgacggctcgtgccgccggcccttggctgggagcccggtgggctcccagcaagctccgtgctgagacgcgacagcgtcgaagccaatactgagcccggctgaaaccggtccttaattgcagggccggaggcggtgtggtcaagggccttaaaaaaggacaatcatgaacgttacaatcacttccccgttctggaagcggcgtcgcgaccagatcgtcgaatccgtcatcccctaccagtggggcgtgatgaacgacgagatcgacaccacggtgcccgacgacccagccggcaaccagctggctgacaacaagagccatgcggttgccaacctgaaggttgccgccggcgaattggacgacgagttccatggcatggtcttccaagactccgacgtctacaagtggcttgaggaagccgcctacgcattggcataccacccggatcccgagctcaaggcgctgtgcgaccgcacggtcgatctcatcgcccgcgcccagcagtcggacggctatttggacaccccgtaccagatcaagtccggcgtatgggccgaccgcccgcgcttcagcctgattcagcagagccacgagatgtacgtgatgggtcactacatcgaggccgccgtcgcctaccatcaggtgaccggcaacgagcaggcccttgaagtcgccaagaagatggccgactgcctggatgccaacttcggtcccgaagaaggcaagattcatggcgccgacggccacccggaaatcgaactcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggccgccgaacctgtgcgcgaccagcagaccgcggatggccacgccgtgcgcgtcggctacctgtgcactggtgtggcccatgtgggccgactgctcggcgatcggggactgatcgacaccgccaagcgtttctggaagaacatcgtcacccgtcgtatgtatgtcaccggcgcgattggttccacccacgtgggcgagtcgttcacctacgactatgatctgccgaacgacacgatgtacggtgagacctgtgcttccgtggctatgagcatgttcgcccagcagatgctcgacctcgagcccaagggcgaatacgccgacgtgctggagaaggaactgttcaacggttccattgccggcatctcgctcgacggcaagcagtactactacgtcaatgcactggagaccacgcctgacggactggataacccggaccgccaccacgtgctctcccaccgcgtcgactggttcggctgcgcctgctgcccggccaacatcgcccgactcatcgcctccgtggaccgctacatctacaccgagcgcgacggcggcaagaccgtgctgagccaccagttcatcgccaacacagccgaattcgcttccggcctgacggtcgagcagcgttcgaacttcccgtgggatggccatgtggaatacacggtgagcctgcccgccagcgccactgacagctcggtccgtttcggactgcgcatccccggttggtcgcggggctcctacacgctgaccgtgaacggcaagcccgcagtgggctcgctggaagacggcttcgtataccttgtggtcaacgccggcgatacgttggagattgcgctcgagctcgacatgtccgtgaagttcgtgcgcgccaactcccgcgtgcgctccgatgccggtcaggtggccgtgatgcgcggaccgctggtctactgcgccgaacaggtcgataatcccggtgatttgtggaactatcgtctggccgatggcgtcaccggtgcggatgccgctgtggctttccagaccgacttgctgggtggagtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaaatacttatgccgccatcgtctgtaataagtcgatgacggcataggccggatgtcagtatcgattggagccgaaaacacatccggggaatgaggtctcctgtgcggggtaatacccgtgcaggagattatttttggcctttcgctgtttggtgtgggtgagtgggtcggggggtggtggtgctggtcggaacgtgaccatggaaggccgctcaaacctcaggtgttgcaaccaccactagaatccgccgagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgattttcagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgaggtcgcaccggctccggcaaaaccctcgcattctccattccgctggtcacccgcctcggttcctacgattcgttcggcgaaatcgcgatggaggagttccgcaaggaaatcaagcgccgcaagaaggccagcctggaagagcgccgcgccgacgacttcctaccgcacccgcgcggcctggtgctggcccccacccgcgagctcgcgaaccagatcaacgacgtgctgatgccgctggcccacacgttcggcatgaacaccaccacggtgtacggcggcgtcaagtacatccaccagatccgcgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccaccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccgccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtggatggttggagcctcgacaagtcgcagtccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgcgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcggccagtacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcgccgcaatgaacgcagccacgaggattacggcttctcctatgacgagcgctcccatgacggccgcagacagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatccacgggagaatccttgacgcggcaaggcggatcgtggaacgggacggtgtggatggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctacgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgaacgggtcgaccggtcgtacggttacctgctcgacctgctgatccgaggcattcagaggtgaatgagttagctccctctgatgagggagctcaccattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagccggggaacttcggacgtacgtcgtcatcgccgccgaaacgctcctgcttgacgcccacatagccctgttcgtcgccgtaatagatgcttggcacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattccttgatgatgcgcgggtaatcgccatggatcacctcgccgaaaatccacgaatacgggtgtgcggctttgacctgcggcaacacgagcgcccagaacgggctcggcacggcatacgcggcgtcgaggcgccagccggcggctccgcgatccagccaatggctcatcacatggaccacatagtcaacggtctcgtcagccgaatggtccagcgccaccagatccccgtgcccctcgaacacatccaaagcgggttcgccattatcaccgacatgcgcgcggaccagaccatgccacgggttgtcggccggattcaagcgtccggcggtctcgtcaagcgccgtctgaacggccggatgattgcggctcacatgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccgtgcttacaaccactgtgcacctcctgattgataccgtgtccattttcgcacatcgcggtgcgaatcccgggtaatcggcatgaaacgcagtccgtgaacatgtggccaagctcacatattgggacattttcctgaggcgctacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgctctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgcccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgctcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcggtggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcatcagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcaccatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccagagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcccgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcttcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcatctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggcccccctctccgaggggagctgtcaccaaaggtgactgaggggagttcctgagtaaggagacatcatgtggaccacatttctggtcgcattgaaagcgaacttgcgtaaccggtcgacgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagccggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgctcgaatcgaccaagacgcgcgtcgccatcatcgaccgcgactccgaccggggtgatatcgccacgtcgatgcgcgcctacctgcgcgattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgatgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcgtcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcccgccaccacgcagctggccgagtgagaaatcagcctttcaaccgataccgctgtgccgggtcgtcggcgaacttgactcgggcgacccgcccttccttcatcagctcgcgcataccggatgtggcggccagcggcgtcaactgcagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcaccccggaacacatcgtcccggctcgtccccggaaacacggcaatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgatgccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggccacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcggcaaccaacccgtccgcgtccgaggaggttgctggctccaacgcgcacgtgacgcccgccgaccgttcaccggtcagccccgaggcccaagcgcgtgccatcgcatcccatgcggcatatagttccgggtagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgagcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcggacgacaccgccgcgcaatatgcttcctcggccgtgcgcgcggtctcgcgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgggatttgccgtgttccggctcggccgtcatcatgacagcgtggcatatccacctgaacggcggctgcgtcatcacgcgactttgtgacaagtcttcacgcttcatgacatccgcgcaaatcagcccctcgaaaccgagaatggcggtcgggattgctccgacaccaagggagctgctgccgctattgtgtgaaaggcgatttgtaccgggttgaaggagaggaacacatggcgcaattgcagccgtactgcgcgattgagggcaatgatgatggattgcccgtcgtgttcgtgcatggcatgggtgtggaccatcgttcgctgatgatgctcgacaaggcgtttgacggcaatgattcaattcgccgtatatatctggatctgcccggtttcggccgtacgccggcattgcccgagcatgcctgcgggctgccggaaatggcggattggctgcaaacggccattgacggtcttgtcggtaaagcggctccattcgccatggtcggcaactcgatgggcggtgcgcttgtccgcgaagtattggcgcgcgaacctcgccgagtggccggtatggcattgatcgcgccggtcgtggacccgcagcatgccggccggcatgtggccgaacatgtggttgcacagcccaatcccaagctgacgcactccttgccgcaggaacaggtgttcgatttcattaccatgggcgtcaaccagtcattcgacgcgtggcgacgctaccaacggttcatcctgcccggcgtggcgttgtgcgaccgtgcggcatgcgaacgactggatcagcgctattggctggccgataatcccgaggaaatgctcggcacatatgcgggtccggtgctcatcgtcaccggcaagcaagaccagatcgtcggatacgaagatcagcaagccctgttgccgcactatcccaacgccaccttcgtgacgctggacaatgccggtcacaacgcgcacatcgaccaacccgaagccgtcatcacgctcgtgcgcgaatgggtggctcatatggcgttcgctccgttgagctgacggtctgctgacagtctgccgaagcctatatgtatacgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcactggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcactcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgttgcgttgttatcactcggcgtccgcggccggtgcctccttgggcgcagagaggaagtgctcctcgctgggcagcacggtgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggcgatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaagccgatcgacgtgaccacgatggcggagacgatgggcggcacgaaccgacgccaatacttggccgtcaaacccagcacaagttccagcagaccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacatcgtagccttcagcgcgcagcgcgtcaccgccgccctggaagcccttctccacggcgatgccaatgccctcgaccgtggcaccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccatcatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgcgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgatttcggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcgggttcgtcctatggttcttcaggctccggttcgaggtcgtcctacgggtcgcgttcccgttccggttcttcgtccggttcatatggtggcacccgtggcggcaaggtcaccacgcgccgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctactactcgccgtacccacctttctgatcggcatctgcaagggcgcgatgatgcactgtcgcatggttatgctgcccacgctcatcgtgctcggcgtgctcaccatcgtgttcgcggccatcgccatctggctcgactctcgcgccgccaagcgcaactgatcgagcagacggccggagcccagccattccgaacgctggactccggcctcgcttattgcaaccgcactataagcaacataaggattcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggaaaagcgcctgggcgccgacctcatggtcgtgccgcaaaacaccgtgcagaaggccgaagcgctgctcaccaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggcccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgattcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaaacagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagagggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtggccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgtggcgcaagccgctgccaccaatgatgaagcggccgccgattcagccgccgacccgttcatgccggatgtcattgcgccaatcacagaccaggaaaacacgccgtcaaacacggctgcgagccgttcggacctgttcgccacccgagctcgcacgctgttcacccagcttggtgttgccgatctggcagacagctacccgcgcgagctgtccggcggtgaaatgcggcgcgtctccatcgcccgcgcgctgatgaaccagccgagcttgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagatcgggtgtatcgcatggacgccggagtgctgtccatagcctcggtgtaatatggtctgctggtgtctgccaacaggtagataccgtctggagtcatagcccatcagcgggtcggcggtaggtaatcgcaagaaaaccaacccgttcgtgtttattcacgacgaagcgctggggaggcccgactcagcgcttgttaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgacctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgatccgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcaccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagcgcgccggcggccagctcggcgaggcgagtatcggtaccgtaatacacgcgggagctattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggtgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcccacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaacgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcactttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaatgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccttcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcagtgaccgcgaacgggtgatgatcatcgcctctatcgccgaggccgaggtcaacaaagccgattactacggcaaagtgacgcgagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtagtcatcccgttagcttccttcgcttggggaagctgatcggacgttggtctcttcattggctccctcgccgaggggagctgtccgcaaaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacgcccatcgccagccaccagaccaccacaggcaacaggccaaacagtccgacagacaatcccataggtatcaaggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcgttggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggctttgggcgaggtggccaagcagttcttggatcaggcgttcggcatccgcaccgtagcccacgtggtggcgcttggtggcgtgcagaccaaccccgacctgcctctgcccacccccgacgatctggaagcgcttgatgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgcatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaattgaacggccgtaggccgtgccgttcgccatcccctcagaaaaagtacttggctcccctctaacggaggtaccccggagtcggatctaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcaccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagcgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcaccggcttgggtatcgattgcgagaatgcggaaagcggaccgactaccgccaatggtggtttgattataccggcgaatgagttcgctgaagcagacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggtgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggttatcccgcacatcaccaacgaaatcaagtctcgtatgcgcgcccaggcttccgatgacgtggatgtgatcatcaccgaaatcggtggtaccgtcggcgacatcgagtcccagcccttccttgaggccgcccgcgaagtgcgccgcgatctcggcccggacaactgcatgttcgtgcatgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgccaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcacgctgactcacttttgtgccgtgcataatatcgcggcatgatgtgctggctgccgtcatcggcgtagcgcaagacatacggtaaagacgtggtggcgaaacatctaatgatgtttcgccaccacgtctttttttgttgtatgagcatcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaacagaaggccatgatggcattgtgattgccgatggcgcggatacggaggttggtgctcgcttggctcaggtgctggccacgggaactggctcagtgaatgtggacggcaaggtagatcccaaacaggaagtcaaggtcgctcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaattacttctcctccggttgcgcaatccaccgtattgccggcggatatgtagcggatgccgtaatgccctccattgccaacggatctcatggttgcgtgggtatcggatgggatgtggccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcggctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgatcgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgcttgaactcaacagacttgtggaacttcagatggaaggatcggtgggctgattccgatgaccgacaacacaacacccgtcaaggaaatcaagattccggtcgccgaccccaacgacccgtacgcgattccggccgctatgccgtcctccgtggaccatgccgtgcgctcgttcaacgcaggcgactacccggagcccagccgcaagcaggacgaatggcgctacacgcctatcgagcgcatcaacgagttcttcaccgtgttcaagccttccggcgaaacgcagatcgaagtctccatgattgacggctcgccgttggccgaaggcgtgaagctcagccagatcaagctcggtgagggcctgtccggcactgtatccaagcccaacgaccgcgtctccgcagtcgaatgggaatccggccgcaccgcaaccattctggaactgtccggtgagatcgcccagcccgtgctcgtcaaggtgcacggcgcgggggaggatctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccaccccgactgcaagtcccgcgtggtctacaagggcgcgcttgacggcaagggcgcgcactccacttgggtgggcaacgcgctcatccagcccaccgcccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagtttgccgtccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccagccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatcctcgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaatacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcctgtataaaataggcactagcacctcaagctagcgcgtctaccattccgccacccgggcaggtgtcgtttggacaacgagtagatagcttagcatgaaattacagggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgactcaaggcaggggacagcctgcaactttccgacggcaacggcttgagaatccaggcagtgatggccgatcctgaagccggactggctgaagtcgtggaagtggggcgcgaacccgagccgctcacccgtttggcgctgattcaggcattggcgaaaaccggccatgatgagcaggccatcgatatggctactcagatcggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgtgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggcctgccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtagagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgctcggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgccggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagtttctcaagatgaagaagatcgacaagattcatcgcgtgcaacggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctgttcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaagggaccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccacactgtcttccgcgctgaaactgttctcccgctccggcttctcccgcgtgccggtgatcggtgaggatgtggatgacctgatcggcgtggcctatttgaaggatgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgagtgccgattgtcggtgcctcggctgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgatcagaacaacagcacgaacgacgtcgatgacattgacgttaccgatgcttccgatgttgccggcgttgccgaagtcgacgcgaccggtgaaacggcgaacgtgaccaagcaggacgtgccgtatcgctccggattcgtggccgtggtcggccgcccgaacgtcggcaaatccacgttgatcaacgcgttgatcggcaagcagatcgccatcgcatcctctcgcccggaaaccacccgtaaggcgatccgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctctcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgagggtccgcagatgtacccggacgatcagatcagcgaggagcgtccggaagacaccatcgccgaactcgtgcgcggtgcgttccttgagaccctggacgacgagctgccgcattcgctggccgtggtggttgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcagctggagcgcctgggcttctaaggcgtatagacgaaaaaagctccctcgtcagagggagcttttgctatacggtttacttccgcttcgtgtacatctgggtgttgaggagggtggagtagcgcttgatgaccttgggacgaatcaccttcatggaagcggtcatcaggccgttttcctgagtgaactcctcgggcaggatgatgaacttgcgcacggactcggcgcgggagacgccctcgttggcctgatcgacccacttctgcacttcggcgcgcacggcggcgttcttggcggcatcctccagcggcatgttctcgtccaggcccttggcggccagccatgggcgcagcgactcctcgtccagcgtcaccaatgcggagatgaacggacgcttatcacccagcaccagcgcctgggagacgaactcgcaacgctgaatgacttcctcgatcgggccgggggagacgttcttaccacctgcagtgataatcagatccttcttacgaccggtgatgtacaggaagccatcgttgtcgatacggcccaagtcgccggtgacataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggctgaacgcgcacggtgcggtggtctcggtcagaccatagccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacccgccttgccattggcggagacttccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgcagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatattgcgaatctgctcggcggaatcggtgtcgtagatggtggcgagcacgccgccgcacgccataatcgccgcgtcggtcaggtcccagtcgtaggaagttcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgttcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggtctcgaccggcacgtcggcgttggacaggtaatcgggctcgtccggggtgtcgtcgtggaccgggtggacgaagtcggatcccaacctgagcgccttacgggtgagattgatagtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggctggttaggggagtgcgtggcaaaatattgcacaggtcccgatattgttgagtaaccgtgagctgcgaaacggtgattgtcgataattattgagcggttggttgctaatcgatgccaggtgattgttggacggcttccgagcaattcatccgcaatgcacatggacacattcgtatttctcactaatttcgggttcgtttctgtttcgattggcggaatctcaagtcatggtctttaccttccggctacacttactatgcggataaccatgtccattttgaagcagaacaagaaagggctctcatggcgcaaaacccagaagccaccgtggtgttcggcgttttgaacgaaacgtccgaaacggaatcccgcgtcgcgctgacgccggatatcgtcacccggctgaagaggagcggtgtctcctcactgattgaagcaggtgccggcattgctgccgactacaccgatgaggattacgaaaaggccggtgcgaaggtgaccagccgtgacgaggtgctcgccgaagccgacgcgctcggttttgtggaccgaccgtccgccgagaccgtggccaagctcaaggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccattggtacgctgaagcgtctaggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgatgagaaggccgccggctttgacatcatcatcaccaccgccaaggtcccgggtcgtaagcccccggtgctgctcaccgcagccggcgtcaagggtctcaagcgtggtgccgtgatcgtggactgcgcagcatccgacctcggcggcaacgtcgagggctccgccgtcggcgagcaggtcaccgagggcggtgtcaagctgattggcgctccctacctggcctccggcgtcgccaccaccgcatccaacctgctttcgcgcaatgtggccgacatcctcgtgcacttcgtgcgtgacggcaagctcggccaggatctcaccgaagaacttgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagccgaagccaatagcccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgcagccggcaagctgcagggtatcaagtgggtcaagaagctgaacctgccgggcaagggcgtatggaacattctgttcgccgtgctgtctgtcgtctcgctggtcatgctgtgcgtccagcccgaacagcgtctgctgtggtcgattctgaccaccgtgttcgccctgtgctacggcttggtgttcgtgattccgatcggcggcgccgatatgcccgtcgtcatctctgtgctcaacgcatgcaccggtacggctgtggctatgtccggtctggcgattgacaatgtcgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgatggtccggaaggaaccatgaaggagaccacgccggacgatctggccgttcagctcgtctacgcgcagaaggtcatcttcgtgcccggcttcggtctggctcaggctcaggcccagcgcgagctcgccgacctcggcgaactgctcaagggccacggcgtggaagtctcctacgccattcacccggtcgcaggccgtatgcctggccacatgaacgtgctgctggccgaggccaacgtgccctacgaggagctcgtggatcttgatgagatcaacccgcagttcccgcaggccaacgtggctctggtcgtcggcgccaacgatgtgaccaacccggctgctcgccgtcccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccctctgtgaggggagctgtcgaacggagtgagactgaggggagtagcccatacgcgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccgccatgaatgaacatcatcggaatagtcgcgtgccgtaatgccttcacacaggaggcgtcctcaaaccggtatccagccttgcgttcagacacatgactggccactttgaccagcagcacggccaacgagtgcggcaaacggaacatcgcctcggcattatccgtaaactgcgagaccacggaactgtatccgcaatcggaaatcgcggcgacgacgttgcgggggagtcgcgcatcgccggccgccatcatcaccgtggcggcgcccatcgaattgccatgcaacagaatgcgtgcatccggatcagctgcggtgatcagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggtgtctcctcgtgcggcatgttgaacatcgaacgtttggccttggtgtccagcgcgaacgtgaacatgacgttggcggccgcggctgtgacgccggctcctgtggcggctatcgcggcaagtgccgcagccatacccctgacaacgcgagtgtgtgcggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgttgagaacgggtaagcgtacgttcttcacaaagttagggattatttcgcggaaaccgtacgttgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggcgtatttcactccttgtagggtgtctttcggcgcgtcgtggcgtctgagcgagacagtacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggcgagaagatcgacgtcgaggtgccggtcttcgttgaaggcaccccgaagggcgctgctgtggcattcgtcgacattcaggagctcaaggttcgcgctgacgtcgccaacttgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgtttttcaccatgtgaactctgctacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgtcagtccctcatcgacaagccggctttcggccaggtgttctccgacaacatgacccacatgacctggaccaagggcgaaggctggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggcgaagtcaccgaggtgttcgcttgcggtaccgccgccatcatcaccccgatcggtcgcttcaagtccgagaagttcgatgtcaccgtcgccgacggcggctccggcaagctcacctgcgaactgcgcgacgagctgctcggcatccagctcggcgaagtcgaggacccgcacaactggatgtggaaggtgtgctgaactagcacctgttgtttctgactaagaccccttggaacagcaacaattccaaggggtcttggcgtattggaaatgttcttggctagagagatacagatggatttagcaacattccgcaacaaataatatgatctaggtcttctgcacgttgcggggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtattcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgctcaaggtgcgttgcctcgcgcggccaaagtcgtttctcgcatctccaaatcgccgaatgctgatagattgttcgcggcgtttgatgagccggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgattacagatcgtaaaacctagaggggctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaagctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcattcatccgcacgccgataccggcgatacccccaataccaaggacgaagaagacaagcctcaggatggttcaaggccgcctcagggctaactgccttcaaagaggtacatctggccttctgcagaatgacaactgctttcaaagaggtacctgaagcacgaaacgttgagtataagtgttgcaatgacggcgtttatagttgggttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcacacatcgaccacggcaagtcgaccgtggccgaccgcatcctgcagttgagcggcattgtgccagagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgccgagccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgaggcccccgcccgcgcgctgatcttcgactccgtctacgactcctaccgcggcatcgtcacctacatccgtatggaggacggcgaactgcatgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaaaatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttccctcgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaattgcgtagtctgattcctcgccaacagtttgagattccgattcaggctgcgattggttcgcgcatcatcgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagctctgtccaccggcgaggactccaacgaccgcgacaccaaagacaagatccgtgccgcccagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtctccaccgtgttcttcggcggcggcacccccacaattctcgccgcccgcgatctggtcgccatgctcgatgccgtccgcaagatctggagcatcgcgcccgacgcggaaatcactaccgaagccaacccggacacggtcaacgagtattacatcaatgagctcgctgccggcggcttcacccgtgtttccttcggtatgcagtccgccgtgccacatgtgctcaaaaccctcgaccgcacgcatacgccggccaacgtggccgcaggcgtcaatgcggcgaacaaggctgggctgcgctcaagcgtggatttgatttacggcgctccgggggagagccttgacgattggcgcacctcggtcacgaccgccatcgatcttggcgtgaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggcccgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggggctgtccggcggatgccggactgggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgaaccgtttcggttgaccaactcgcccccatgatcagcgaaggcctgattaccgtatccgataatcatcgagtggtgcccactcgccgtggccgactgctcaacgatgcggtaatcgagcagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccgcgtcatcgcggttggacaggatgctgtccacggcggcctggcccatttcggccagcggcagatgcacggtggtcagcggtgggaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtgcggctgaacttaccgttcgccacggctttcggatccacggtgatgcctgcctcgtccagcacttccatcacaccggccagtcgttctttggaggagcgatgtgcgtcatcgcccttgagaatcgcagggcgcgtatacccggaatcgacgatcagctttgcgatggcgcgcgcgccgacatcgttcgccacgtccacggccgggaagggcaggttgcggttgagcacgaacacggcgcgtccgccggatgcttcgtactgggtgagttccgtctgcaacgcctggcgttccggcgcgtcggtgtattcactttcggagatgatgatgccgcgcggcctggtggatacagacttacgcaccgcctccaactcttcgtgcggggtggctgccacgccgatggtcacggaaatgccgcgttcgaccgccgccttgaccacgccttgcgatacggatgcgaagtagggatcggagatatcggagaccagcagcacgatgttcggtgcggtgcctttggccactgcctgagcataggcgttgggacgatagttgagcttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcggtccttttcttccctgaaacggaaaacgtgtctaaacgtttaccgcaacgatatcgcatttttgcttgcaatagtagcattgtggattggaaagcctgaattctgaacaaaaaaataatcacgcgaattacggaaagcgtttaccgtttcggcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccactggcggatcgatgcacgccgtgccggtccacgacccgctcggccggcctgtcgaaggccacttcggtctgctcgccgacggcacgaccgccgtggtcgagacagccgaagccagcggactagcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggcccttggcgttcgtcttctggacgggaacggcaacgaccttaagcacgggggagcggctctcgccgatctggccaccatcgatatcagcacgatggacccggctctcaagaacgtcgccatcaccgccgcctgcgacgtgaccaacccgctgaccggccccaccggagccagcgccgtgttcggcccgcagaaaggtgcgtccaaagatgatgtcgccacattggacgccgccctcgcgcattttgcgcagggaatcgacagccagctcggcgttgccgtgaacgacgtgccgggtgccggcgcggccggtggcatcggtgcagcactgaagggcttcctaaacgccgaattccgcccgggcatcgccatcgtcatcgaacaatccgggctcgatgcggccgcgcaatgggctgacgtggtgttcaccggcgaaggctccatcgacttccagaccaagttcggcaaaaccccggccggcgtggccgaaaccgccaagcgccacggcaagccggtcatcgcagtagccgggcatattggcaccggcatcgatgagctgcatgaggtcggcatcgacgcggtattcggcatcgcgcccggagccgccagccttagtgagctgctggccgacgcggccgccaacgtgacccgcaccaccgaacaaatcgtacgaaccctacaactgtgagcaggctcccgctggcgggggctggcgggcttcgcccgactggggggccagcgctgagaaccaccctcagtctcgctacgcgagacagctcccgccagcgggagcgagtaccggaaaggaagacatgcgcgccacactggaaaccgtgagctgcggcgaactgaccgccgtgtatcgcaaagacagcgacactggcatcgtggaactggcatcatggatcgtcgacgcgagctcggtcttgtgacatgattggtggtgatggaatcaacgatgagtccaacaaaacggcaccgcctcccattgcgcaatatcgcgcgcaatatcgcgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgattacaccctgatagccggccagccgggagccgacgaacagggtaatcgccagcatcacaccctgcctgctgatcgacagcacaaaggcgccgaccgccttgcctgcggactggaaggtgcaggtcgtgaccatcacgacggctacgcacaccaggctcagcagctgaacccgcagcatgccggcgcccagcgtgatgatggtggcgtcctcgatgaagaatcccatcagcagacggtcggacaggctgagcaccacggtcatcaccagggcgaacagggacaggaacaggtaggaaaaacgcagaatgccgcgcagtcgaggcatattgcgggcgccgtagttgtagccgatcagcggctgtgcgccgaacgcgaatcccacgaaaaccagcaccgcgatcatgatgactttcagcgcgatgcccatcgcggccaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaacccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagcgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccgtcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgtcgtacaccaaggtgaccagcatgctgagcaccacgggcatcgccagcgagaaatacgcctccggaatcggcgccttttcgaagagttcgttatccatttccgtcccttggtgtttcgttcttcagtcactgtgcaggatgccgttcggcgtgcatcacaggcattgtagaggcaacagtgtggacaacggacgggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgagggggattgccttcgtatgtgtcatgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggctcagcgagcgttcttgttggcttcgttgatcaggtcgacgagcgtgctgctgttggcgcgaccgcactggctcatggagctcaggccgtacacagccagaccgcgaatcatggaatccttgagagacatcatgtttcctttcgttggtcaaaaccttgtggctttgagttttgtttatcggcttctttctgaaaccggtttcagaataacgcagtccgatgacaaacgcaaagggactattccgctctcggcgtttctggcggaatatcgccgttctttagataccgttcggtagttaagaggctgtctagtcgaccttctgacggccttgttctgagcgtacggttttcacgaggtatggcctcatgtcgcggaaatcgtacgctgagtcgtcgtaagcgtacggttttcacgaaatggggtctcatctcgtgaagaacgtacactgagtcgttctgggcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatggcattgcgggattgtcgggattcatgaactgcacctgcagcaggggaatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaagagaatgccgttatgctttcgcgtcggaatccgattgatatagatgcggttgagacgcgcctcgtctccgccgccgatgccggacttcgaggcgatgtgcactgtgccgtcgtgcagggaatagttgtgctgcagtccgtatacgcacgccgcactcaaccccgcaaatacccactgagggtggattgcggacaacgcacgtatgacctgcaatgactgttgctctctggtcatggtgttccaaagtgttcggtcggcgtacaggttcttatacggtgacaccagctccccggcatgcaggcgacgtttcagggcgcgccgttgcgcatcactggtgccatagcagcagcgacgctcctgcttcgcctgctgcagcagtgcagaaacttccttgtgttctttcatatctcgacgttaagggtgattttgatcgttgcacaagctcaaccggcaaatgtggatactatgtcacgcgaattgttgctgtggataacttgaatcgacgtcgacggctttgccgacggtcttgtcggaggcgatattagcctaggacaccttgctgcgccgccttccataccgaaaacagtcatcagtgacaccgggggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgttcttcacgaaattagggatgatttcgcggaaaccgtacactcaccgcaactcagcgtacggttttcacgaaattattgatttggatataggttccccgtcatgaactacaatgaatcgcggcaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaatgtcaccgaagacaagcgtgaacgcatcgccaaggccatcaaggagctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcattgccgcactggaatacattcccaaagatatgccgatggtcgtggtgggtggcagcttcggcgacggtgaataccaggtcatcaacgccgaaagggatggcggccgttggatgaccatgcatctgctggatctcggccatcgcaccgtgttccatgtggggcgtccggaaggtccgaccgataacacccgcaccaatgggtggcgtgacgcgctcaaggagcgcggcgtcacggcacctgacccaatcatcgtgcccgacgatgatttggaggagtcggtcaaggctgggcgcaccttgggccgtcgtggtgatgtgactgcgattttcgccggcaacgacgagaccgccatcgctgtgatccggggtctaagggaggttggtcgccgcgtgcctgctgacgtgagcgtcgtaggctttgacgaccgcaacttcggtgccatgtggaatccggcactgaccagttacacccagaacttcctggacatgggggagcgatccttccgaatgctgttcgaacagatccaggccaagcgcgccggcgatgacgcgccgccctcgcaggtcgaggtggtgcaaggcaagccgtgtctgcgagcctccgaacgcgcgtacggcgacggcgaaatcgcgtagtcgatggggacgtgcgtatcaatcgatagtgactgtagcgcatccatatcgtggtgaggagtctctcatgccgaactgtaagcgcttaccttaagtagtttgtaatatggtttacgtcataaaaatagatattctaaatcatagtgttttgcaagggcttttgcggaaaatggctatttatcaacagttttcgaaaagtccgcatgacgggcgactgtgagcacgctttatggtaaccgctttccgtagcattatcgttagagtatgacttttgaacaatcggcaactctgaagactcagcaccagacctcgggcactatctcagcggcagacgccgcgatgcaatcggtccgcgacgaacgcatccccggcaaactcatctgcgcgatcgtggccgtggtcattgttatcgtgttcgtcgccatgctccacgccctacgtaaccggaagtaggttgtaggcgggattggtctgactggtatccgccacagccgggttcggtagagcggctaccaatcggccagtgtctctatggcatcgaatcctgttctgcgatgttgttcgtcaaggttgttccagtaaggtgattcatcggtgagcatgtcgtacgggagcttgatacgtctgcgatccgtgtggctatgtagtcgccgagtttcggcatcagggtcggtgatgagggatgcgagcattgcggcatcgtacagatgtctatctccatatccggcatggtctgcttggtatgcggcgctcttaagaatcaacgcgccaagcagatccgcgtcggtagcgggacgcacgtcgagaccgcccatgatggcgtgcaactgcaccatgagaccgccggtgagcagtcatgattcggcaatgcgctcggccaccatgtatacgatattccacggatgagcgccgctggggattgcaatgcgggaaatcattgctcatttccttgttgtatgccgtgatgagttctgtaagggtttcgagcccctgcgcgtcgttctctcgggtcgttggattcggccagatcagcggcgcatacgccgatgggcatgggcccctgcccggcgggcagaaaatcagcgagatgccgtgattcggcgggagacctcgtgatggccccagcccttctgttcggtagtggtaccgctacaccgactctccccgacactccagtgccgccgatatcagtgaatgcccagcctgatgtcggtagagtaaaggctattggcttggtctcgacggcgagacttctccaatggccaatatgcactgttgcaaaggagcatgcggtatgcaaccaatcaaagccattcaatacggctgcggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggcccgcggcatcagcgtgatcaccacctgcgaggaatgcatctacccgtggaccaccgatccggccgccacgaaccgtctcgacatcatcgccaaggaagccggtgccaccatggtcggctccggcatgcaggacatctactgggtgaacatggtctccaccgtcgccgccggatgccacagcatcaagaagatcaccggtgcggtgagctacaacgtcgaggattacggcctggctttggccaaagcgcacggctgcggtctgaccgccgaggagttcgaggccgagctcgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagacgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgaacatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggccggtatcaggcggacagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcgcgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaatacccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggccgtctcgagcccggcgagatgttcctggtcgacaccgccgaaggccgcatcattcccgatgaagaggtcaagaagagcctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcgctccgatggccaacaccggcaaggaaccgctcggttccatgggtaacgatgcgcctatgcctgcgctttccagccgcagccgcatgctgttcgattacttcacccagaagttcgcacaggtcaccaacccgccgctggattgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgtctcgacaaggcccgtatcctcggcggctactaccgcccgtacgtggtcaagggcctctaccaggtcgccggcggcggcaaggccctcgaagagcgccttgccgagatcttcgccgaaatcgacgaggccatcgccaacggcaagaacttcatcgtgctctccgaccgtgaatccaaccacacctggggtccgatcccgtccctgctgctgacctccgccgtgcagcaccacctgctgcgccgccacacccgtacgcagatctccgtggccgtcgaggccggtgacgtgcgcgagattcaccatgtcgcgctcctcatcgcctatggcgccgcctgcgtgaacccgtacttggccttcgaatccgtggaagatctggcccgtaacggctacctcaaggtcgacgcggacaccgccgtgaagaacctcaccaaggccctctccaccggcgtgctcaagatcatgtccaagatgggcgtctccaccatcatgagctaccgtggcgcgcagctgttcgaggctgtgggcctgagccaggaagtcatcgacgaatacttcaccggcaccacctcccgtgtgggcggcgtgggccttgaagaaatcgccgaggaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgatcgtatcaacgacccgcagcgctacagccgcatcaagcagatcgcgtccgctcgcttcggcgtgacctccgattacctcgtgcacgccaccgatttgcagatcaagctcgcccagggcgccaagcctggtgagggtggccacctgcccggagccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgccgcaggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtccagtgcgacggcgagctcaagaccggtcgtgacgtggtcatcgccgccctgcttggtgccgaggaattcggcttcgctaccgcagccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcattgctgaggaggtgcgcgagatcctcgcccagctcggcttcaggactcttgaggaggccatcggccacgttgagtgcttggatcaggacgaggccatcaagcgctggaagtccggcggcatcgacctgaccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggcgaagtcaacgactacgccggcaagggcctgtccggcggtcgcatgatcgtgcgcccggaagatagcgtcaccttcgacaagcacagcaacgtcatcgccggcaacgtcaccggtttcggcgccacttccggccagatgttcgtggccggacgcgccggcgaacgtttcggcgttcgtaacggcggtgccacgtttgtggtcgaaggcgtgggcgaccacggctgcgagtacatgaccggcggcactgttgtggtactcggccccaccggacgcaatttcggtgcaggcttctccggcggtaacacttatgtgcttgacctcgatatgaagaaggtcaacccgggtgccatcaagtccggtgcactgctcttcaagtcgcttgatgccgaaacctccaagctggtgtacgcactggtcaagcagcatgccgaagagaccggttctcagttcgccgcggccctgctggaggactggaacgagaccgtcaagcggtttacgcacgtggtgccgaagcagttcgtggccatgacgaaggccatggaagaggccaaggccaacaatgtagatttcaatgcgcccggcgcctgggaaaaggtgtacgagcaggttatggaaggagcgcgctgacatgggcgacccgagaggatttctgaaggtccgtacccgccgagagctggctgaacgccccgttgaggaacgcatcaaggactggttcgacgttcacgccgaaaccggcctgcaaccgtggacccaaacgcaggcggcccgctgcatggattgcggcaccccgttctgcatgaccggatgcccgctgggcaacctgattcccgagtggaacgacttggtccgtcagggcaagtgggaagacgcctacaaccgtctgtccatgaccaacaacttccctgaagtcaccggccgcatctgcccggccctgtgcgagcaggcctgcgtgctcggcatccaccagccgccgaccatgatcaggcttgacgagcagaccatcattgaccaggcctgggatttggactacgtcaagcccctgccgccgcagcgtctgaccgaccagacggtcgccgtcgtcggctccggccctgcaggccttgccgctgctcagcagctcacccgcgccggccacaccgtcgtcgtctacgagaaggacgacgccatcggtggtctgatgcgttacggcatcccgaacttcaagcttgaaaagggtctgatcgaccgccgtgtcaagcagatggaggccgaaggcacccgcttccgcaccaacgtggaaatcggcaaggacatcacgtgggatgacctgcgtgaccgttacgacgccgtcgtggtggccatcggctcccgcgtgccgcgcgatatgaagattccgggccgcgagcttgacggcatccacttcgccctcgacttcctgcccgacgccacgcgccgtatcttcggcgtcaagccggtgcacgacatcaccgccaaggacaagcacgtggtggtcatcggcggtggcgacaccggttccgactgccttggtacctccatccgtcagggtgcgaaggatgtcaccgtgctgcagatcatgccgaaagagccgtcttcacgcccggacaacagcccgtggccgaccttcgcccgcacctaccagaagacttcctccatggaagagggtggcgagtacatttactcgaccgactcggtgaacttcgaaggcaccgaagaggagaaggccaaggtcaccatcgacaactcgaccaccgccgaaggcttcgtggccgatgaacgcggtcacgtcaccggcctgaaggtcgtctccgtggctcccggcgagaacggccccttcacccgccagcccggtaccgagcgcgtgctgccggccgatctggtcctcatctccgtgggcttcctgcacccggacaccgagaccatcctcgaccagctgcccgtcgaactcgacaagcgcggcaacatcgcccgcaatgacaagttcgccacctcccaggacggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctgaatactttccaaacagaaacatgaaaatcccttcttcatgaggggatttttgcgtttctgggattaattactgccttgagtcttaagtaatgtttatatttcgagaatattgcatacgtggttaacatgaagctcctatggtgtctttcgtcgccaaaaagacgacgccagaatatttgggagagattcatgaacacacgtcatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcactttcaccattcctgaatggctggaacacttcggccagaacgaggaaggcaacctgcgtcgtcaggccatttccatgtccatcgaccgcaagaccgtcgccgagaagatcttccacggtaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgaattcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagccccccgctggcgggggctgtcggcaaagccgactgggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacaatgcagttcgcttttacgcgcgacggtgccgaatggaatacctgcgctgatttcaagccgaccctgcaatgcgcgcaaggcaccttcgcgttcgcggatgccacttccaccacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaggcggcgcgcaatccctccgtgcgtgacctgattggtcgctcgtgggtgcacatcggcatcaaaaccaaagtgcagcccgactcgtactactacgataaggaccaccccgagaaaaacgagtcgctggtcaccttcgcacagcgcgaaaagcaaatgcgaacactgcacggcatgggtgcaggccgactgtacatgcacttggatggttgggcacagcccggatacgacaacgcacaccccgactatctgccggcctgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccgccagacctacctgtgcgccgagctcgcaccggactacgtgcgccgcaatttcacccagattgccgcgcatggcatcaaactcgactgtgcatacttggatgtcttcacctgcaacgaaggcgacgaatgctcgaaccccgaacaccgcatgacccgccgcgaatgctttgaccgccgcgccgagtgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtgccggtgccgctgtataacctcgtctaccatgattgcgttatcgagccgtggatgatggagcgtgtggtggacggcgacgattacatgctgtacgccttgctcaacggcggagctccatacctgattcgcgatgccgcatacatcggcgttgacggcgacatggacgacgaacagcgcgctcgcacggaaaacgacatcgaacgctgccatacggtcgctgcattccatgagcgggtcggcatgcaggaactggttcgtcacgagttcgtggatgatgatccgctggtgcagcgttcggtattcgcggacggcactgcggtcacctgcgacttccatacgcaaacctatcgcatcaccgactgaaaatacaatgacacacagtgggttccgatggactggtggcaaattgccgccgacaagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgcggtcgctcgggaatgattgacgaataccagctgcagcagaagtcccagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgcgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcacaatccgaatctggaccagaacggcacggccgtttgatcttttgcccggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcatgtctatggtggggccggtgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggatgccgacattattcatgcgcacacctggtacgcctgcctggccggctacctggccaagatgctgcacggtacgccgctggtcatcaccgcccactccctggagccgttccgcccatggaagcgtgagcagctcggcggcggctacaacctgagctcctgggccgagaaggacgcctacgagcacgccgaccgcgtgatcgccgtttccggtggcatgcgcaaggatattctgaccgcctatccgaatcttgatccagacaaggtggttgtggtttacaacggcatcaccatgtctgactttgctactccggcgccggacgatccgggctggaaggtgtttgagcgttacaacatcgaccgttccaagccgaccctgctgttcgtgggccgcatcacccgtcagaagggtttgccgtacctgctcaaggccctgcacctgatttccaaggatattcaggtggtgctgtgcgccggtgcgcccgacaccccggagattgccgaggaagtcaagaacgcgttcgccaagctggacgaggagcgtggcaacatcgtgtggatcgaggaaatgctgccgaagcctgagctgaacgctctggagcacggctgcgacgccttcatctgcccgagcatctacgagccgctgggcatcgtgaaccttgaggccatggcctgcggtctgccggtcgtcgcctccgccaccggtggcattccggaagttgtggtcgacggcgagaccggctatctggtgccgatcgaccagctgcacgacggcaccggcacccccaccgatccggacaagttcgtgcacgacatggccgccgccatcgacaagatcatggccgatccggagctcgccaagaagatgggccaggccggctacgaacgcgcccgcgacgtgttcagttgggagtccatcggcgacaagaccgtggaggtctaccagtcggtgctcgacgagcagaagaagtaaaagcgagacagcgcaggctcgcgcagcgtgacggagggagagaccgtgcaataagcggtgctctccctccgttttgtaccactgaggagaatcatgtcccaaaccgtcctccaacttgacaacgtcgaattccgccgcaaccgccgcgtcatcatcaccgacgtgaacctcaccatccatgcgggggagcgttgggtgctgttcggaccgaacggcatcggcaaatccaccgcagtcggcatgctggccacccgcaccttcccctcggaaggccgcgtgttcattctcggccaccagctcggcaaatacgacgtgttcaagctgcgcacccgcatcggtctcgcatcggccgacctgggtcgccagttccccgagttcgaggacccgctggatgccgtggtcaccggcctgtccgccgtgaccggacgttggcgcgatacttacacggacgaagaatacgcccgcgcacgccagctgctgcgtgatttccgcgtctcctatctggaaggcaaggagatgtggcgactgtccgaaggcgaacgcacccgtgtgctgatcgcccgtgcgctgatgggcgatcctgagcttttgattatggacgagccgaccaccggccttgacctgggcggccgcgagcaggtgatgcgcacgttgagccgaatcggcgaggaaagctctgaacgtgccgtggtgctggtcacccaccgtctggaagagattccggcaggcttcgatcacatcgccattatgggccgcaagccgattcccgccgaagatgccaccgaagcgggcgtcgactcaatgggcaatcccggtgctggcaccatcgtctataccggttcgctggaagacggtctaaccgacgagcgtctctccgacctgttcggcatgcccatcgaagtccagcacactcacggccgctgggccgcctacgccgtgtgatgccgttttggtctccgccagcggaagccgtcggccaagccgactgggggaggtgtcagcagtacttttcctttttcggcaggttttatttttctcttcgccccctctggagggggctgtcagcgtaagctgacttggggaggttcgacatatgacggaaagcgacatgactggtagcaaactcgtattcattgatatcgacggcacgctggctgatgagaatcatattgtgccggagtcggcaaaaacggcgtgtgcgcgggcccaagccaacggtcacaagctcttcatctgcaccggtcgatccgtgccgaaaatcgaacgcaacattctggatcttggattcgacggtgtagtttccgtagccggcgcacaggcgaatatcggagataagctgctgttccagcacctcgtatcgcccgaagccatcgatgcggcgatggcctattttgccgaacaccatatcgagagctaccagtggcagggtgcggacggcatgtacatttccgaaggttatcgccgccatctggagtccaagggcaagacgtggaatcgtggtgagtttgcgcggttctggcatctgctggacgaggtagaggttccggctggatctacgctggggcacacgattcatgtgagtaagggatcgtatttcaccgggcccgagccggatacttccttcgaggacactcagcatgatcttgccccctggttcgaactcgtgcacggctcatacgacaagatctcgccgaataacggcgaactgctcatcaacggcatcgacaaaggcaccgccgtgcgcgacgtggcttccttgcttggctatgccatcgccgacaccatcgccatcggcgactccgataacgacaccgccatgctcaaagccgccggcacgtccgtggccatgggcaacgccatccacggcatccaggccttctgcgacatcattaccaccgacatccgcgacaacggtctagccaacgccttcaagacattggggctggcgtgacgagtgcgaagtccttaccagttgcgattgcgcaatttacggtggcggaggagccggaacggaatctggagatcatcgacggattcgcgcgtgatgcggcggcgggcggcgcgaagttgctggcattgccggaaggtttgattgcgcggcgcggcgatgacgattcatatgctgccgcgcacgcgcaaccactggacgggccgtttgtagacggcttgcggcgtatcagcgcgcagcggcatattgtgctgatgggtaccgtgcatgttgcgccggagcaagtaacagaacgggatgcagattcccgagtttccaacacgttccttgtgattcgcgatggtgaaattatcgctgaatatcgcaagctgcatctttacgatgcgttcgcggcccgcgaatccgacgtggttctcccaggagatgcgttgccgcctatcgtcgatattgacggttggaaaatcggcgtcatgacctgttatgacgttcgtttcccggaaaccgctcgctcactggccgtgcgcggggcagatgcgattgttgtaagcgccgcttgggtgcgcggcccgttgaaagagcagcattggaagctgctgactgcggctcgcgcattggaaaacacttgctatgtgttggcttgcagtgaggtgagttcgcggaacatcggatgctgtcgcatcatcgacccgatgggagaggtagttgccgaagcgggcgatgagggagccgagcttattgctactgggcttagtcgcgaatgccttgcttccgcacgccagataatgccggttctgcagaatcgccgttttgccgacccgcagttgcccgattagtcgagtctttcagagcccgctgccgacgctttgatggcatattactgtcgaatataacgtgccgaattattgacgcaatcagtggtcatcgaaagtctgtgatagatgtcgcgggctcggacgcctatcatgggacgcatgactgctactgttcatgattccgcccaagctcctgtatacgctcgtctgcaagaggggagtgatgctcctgatttcactctgccggcgattgtgcccggcactgcggagaacggcttaatcaatctgtctgacgtgctcgaggacggacgtagggttgtactgtacttctatccggcggcaatgacgcccggatgcaccactgaggcttgcgatttccgagataatctcgcacgcttggagtcgcagaatgttgcggtgctcggtgtctccaaggattcactcgagaaactgcgcaagttcgccgagcacgaccatctcacattcccgctgctgtctgatcccgacctgaccgtgcacaagctgtacggcgcatatggcgaaaagaagctctacggcaagatacacgtaggcgtgatccgttcgacgctcgtcatcaatcccgacggttccgtggcgcttgctcgctacaacgtacgtgccaaaggtcatgttgattcgctgctgaaagcgctggacaagctggagaagtgattctgcggttaagtcgagcttttgcttcgctgagcagtctcagtgaggcaaatcctcgggcggactgaggcattgctctactaaaaggccactagcgaggcttttcctctactaactctctgagttgcttcgctgacgacgattcagcggggtattcccttgacctatccgtgttttcgctctgcaaagtagttctgagcggcggatcgatactcacacagatgtgtacggtgtgctgtcagcgtctttgtagtttcgccggtcagttgcttggtaatccaggataagtcagtcatggttccttacttccgtgtgaggcggtacacttgggtactgcctctattgagtgcattgataaaggtcagccccgcaagcgctaccaacacttgcggggcatttacgtttgatacaaccgagaggaaaccggggacgaatccccggcacgatagcgtgttatccgacgttcagcgtcagcacttccacgccatcaatcaggacaatcaccctagggtaatcgtctatgattagcagagtatggtattcgccgcagcaatcgcagcgccatacggtgccgagaccatatatcatggttaatatcctctcggttgtaggatgacccgcacgtttgtgtgggccaagttccgcaagggacgcgaaagccgcaagcgttacagcacttgcggctttcgttttttcatgttccgagcggaacaaccgaggggccaaacggcccagtgcctagactatggggtaaacccagtgagctaggccgactgtgtacaatgcccacagtcaggcaaagaattgattagggcgcacacctagctttcgctagtgttttctttcggcttctcagcctctaacagtttgcgagggttactcactttcaatgcgtcgcacaattttaaggccatgcctaacgtcatgttttcgatgggtatccggcatgactcatagtcacctacgcgaccttgactcatgccttctaccttgcttgctaaacgttgttgcgatagccctcgcttctgccttagctcccttagactcattacccacctcacttgtgctcagtgggcccgattatacctatcgttgaaacatatgtagagcgaggggcataaatcgaaaggcgtcaatgatgaacggaacattcgagcagttaagagcagccgtgtatggccaagcagtcggtgatgccttgggcgtgccttatgaattcatgccgagagatgccttccgatgcgaaggtatgacgggatacggtacgcataaccagccgattggcacatggtcggacgataccagcatgatgctcgccacattggactcgctgatcgccaatgaatggcaagtcaatactgaagatatgggagagcgatatctggcatggctgagtaatggcgaatacgcgattgacggacgagtcttcgattgcgggcgaacggtctccgtcgcgttgcagcagcgtgtgggcttaagcggtgaacgagacaatggcaacggctcactgatgcggatcatgccgttggcgttcgcggatgcttccgcggatgacgtacgtgccgcatctgcaatcacgcacgcccatgcaatctcgatggatacctgttcgagcatggtggatgtgttgcgcgacggactcatcaaaggcatatggccgcaagagctggatgatgaaccgctacgcggtatgccgcgtgatgaagttggttcgagcggcttcgtcaaagacacgtatgaggcggcgctctggtgcctcgcgaataccgatgattatgcgagttgtgtgctcgccgccgtcaacttgggtgacgatacagacacgaccgccgccgtcgccggatacctggccggcatcaaatatggattcgatgccattcccgctcagtggctggcggtattgcgcgggcgtgagcttattgaggatgtgcttggacggacggagtcggcgtggcattaaggcgctcgcggtgagtagcaacctactgtttccgtatgcgatgaagatggccagtacgccaccatcaacagtgaggactccctgcctactgttctccacgatcacgcccaagcactggacgctcccatgtctcgttccgctgaacattgccgagaactcccttcttctggatgcgcatcatcgaatcccacttgctcgacgcctagactgctttggacggggatacgccgctagtgggggacagagattgagacgcattcgggttcgaatagtgtgagggatttggctttgccaacggttgttggacacattccatacggtggtgcctgtgttgttcgcaaaagtatgtctatctaatcgttaatcgaggatgacgatatggtgagtttttctgccgctataatgtaggattattaacaggttacggctgaagaactgattacagtattagaacattttttttctgatatatgtggttggcgtagatgtggcatatgcgagggggcatcctatggcggatgatgaaactcatatcggtcgaaataacgaggaacgcaaggaagacgaaaaccgtcgcattatgggaaaggcgctggaaggtgttgcggcggaaaccgtgcaacgctttggttctgccatcaaggaacatttagcggcctatgcgggtgatagagagaaacctgctgatgagaattccagacctcctaagaccttgaagtccattgctaagatggagactagcaatgaattcaaaaagcagaatctagctcagcaagcgggttttagtgccgaggttgaggcggtagccaggaagaacgccgataacatcattgctggcaacgatacgcgattcaaacgatatgatgacgtgaagcatccagatggacggcaagtgtcgaacgaccccatcgtggacattgtcgaagtggatgacttgggcaaaccaatcatcggctctgaggctcaaatgaagttcgtcggcagtagcccgaaaaagcttcttgataagttgaaaagcaagaaatatgcaaaatatcgtgatgcagacgtcagcatggttattccggatgattattacgatgtactgatgggtgatgggcctgacggcatcaacgaacagatacgaaaacttcagggcgagctggatggaggtcggcttgccggcaagaattctgaggctattcagcagcaaatcgatgatctgaaacagattaagaaaagcctgcggaaaagtggactcaccaagcgagaagcgttgtatgcgcgagaacatcccagacgcatggtggcgaaagatgtagccagagttgccaataaagccggtctgcagcaggcaaggaatggtgcgctgattggtggtggtgtttctctgattcgaaatatggttgcctgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcagtacctgcagatggtgcttttatggctgcgatggttggtatggctggaagcaccttgggatatgctgcagctgttgccgtatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttgaccggaaacgccgaaattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgccgatggggaatatgatgcagtagaaagcagactcatcaaacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacggccgcgccagccccggaagtcatggttccagagaaggacgtgtttgatcagaccaaggatgctgttgactcggtggtcgctccggttgtggatcaggttcagcagggtgctcagggagccgcggatgcggtgaagcatacgtttgacaataatgttgctcctgttctcaaccaagttggcgatgcgctgaagccggtgaatgatgcagtgctgaaaccggtaggcaacgcagccaatgaggttgcgaaacgtgcgggtgacgcagccaatgaggttgcgaaacatgcgggtgacgcggccaatgaggctgcgaaacgtgcgggcgatgcggccaatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcagattccctgaatgccttgggcaaagagaaagtcattattttggatgggagcgttcagcgcttccttggtgcttttcaacagctgaaaaatgttgatttcaccgcgtccgaagggcttgatgaactcaataaactgcgcatagacaaagcggcttttgatgaacttaaaaccatgggaaacatagcttcgtctttgctggaaggcggtgtggccggggcagccagcggtgcattggctgcgtttggtgcatatagtgccgcgtcggcacttgccacggcttccacaggaactgcgatcagtgcattaagtggtgtggctgcttccaacgccacgttggcgttcttcgggggagggtccttggccgcaggtggcttgggcatggctggcggagccgctgtacttggaggcttggtggcaggtcctgcattgctggtcatgggcgttatcatcggtgccaagggtggcaaaaaccttgaggaagcgaagacccagtctgctgaggcaagcaaatactgtgaacagatgatggccggtgcggaccagtgcgttgccattcgtagacgcagctatatgttccacgctttgctcgcccgtcttgatgctaaattcctgccttcaattcttgaaatggaaaatatcataaagaccgagggaacggattattcgcaattccgtcaggaaagtaagaagactattgccgcagctgcgtccactgcagcatcaatcaaggccgtactagatactcctctgctggccgaggatgggtcacttactttggagtcggagaagctgatgaagaacagtggcatgtgatgggatgaggattccggagctggactgatggttctgtgtcttcttccgtcatttttcagggcttcatatagatacgacgcatgacgaattctaccaggcgatctgggaggaagcgcttgagttgcatcagggccttgtagctgctgccgacggcgatgcgcaccgggggattgcgtttgccgagcgtcgcgacgatgactcgggccacgctttccggaccgtcgccggtctgctcgtcatgagccatttgcccgaccgaacgttggcattcgtcgtagtacggtgaattggctggttcggcgaggatacgcgagccggtgaatccagtggataggtcacccggttcgatgattgtggcggtgatgccatgacggcgcccctccaaccgcagcgcctccacatacatttccagcgccgcctttgtggaagagtagtgcgattggaacggcaaacccagccgtcctccaatcgagccgacaacgatgactcgtccccgcttacggttgcgtgccgcggtacggcgcagcaacggcagtgcgatttcgttgacctgcaacacgccaaaataattcacatcgaactgcttgcgagcgagcgtcattggtgtgcattccgcagagccggcgatgccgaatcccgcgcaatggacgatagcgtccaatcgggggagagcgccgagaatgcgcgtgatgtcagccggcttggtgacgtccatttcgtaggtaagcagttcgctgtggccaagacgctgagtctcagggatattctcgtccgcaccgagtcccactgcaatcacacgccaaccccgcacagcgagcatccgtgcagtcgccttgccgataccgctcgtgccgccggtgaccaatgccaccggccgtccatcatctttgattggttccatgtgtactattatcgcgcggtggcgatgatgaaatcacggcatagcaataatgcaagttgccgaacggatgagtgaggctcttagattcatggaagacacaatgaaaaaaagagtggagcaaccttcttactggaactcggcaatgactctagaaaacgtataccagtgaaagcaccagcaacgtgctattctataaacgtttctggtttcaaacacttttttgagaggtgtgtatgggtcttatacaagctgattttggtgatgttgaacgtcggtccactagtaattcagcagatgaggctttccaacgcattttcgggtttccgtcttctgtaatccgggaatcagcatggcgtgcactgcgtgtcgctactggaactgatggtgtccactcccaattgagtgcggcgggatcgaagttttatcatgagtttgtgtcagaggttcgagctttcatcgataccgttgacgaatggagcgcaaattgttcggacgataacaaaacgtctccacgagcataccgttctgatggtttaacattagccttcgcccaaggatctccggctaccggaaacatcaacaaagagttgcatctcaagaaggttccgggaactgtaacattactggagcttcaggagaaagctccggcgaagcagcgagagctgtctttcgatgccttgacctccatggtgccggcgcgtccgcagatgtggttggtggtgtactaccgagaggctgatttggtgcggttggaagtgtcgcttcccgctggtgtggattctaatgggaaaatcattggttgggataagcgacttatgttggacgaagttaatttgaccgatcagtttgtggaggcacgtaacgatgagcgtggtgaagatggagttgccgtcgccatttccgcgcgttgagcagaaggcttcgctgaatccagaacgtatccgctgtgcccgtgaaacggcaggactgagcaaggtgcaattggccgaatctctcggtgtgacttcgcggacggttaccaattatgaagaagtcggagcaccggtgtctcaggtagcggcgttggccgatgttttgcaggtcatgccgtcgttcttttccgtgtctcctagtgctccgctgattgaggatttatcggaagggcaggtatggttcagatctttgaggaagtcgacggtaaggcagcgtcgttcggcagtggggcatggtcggaatgcattgctgttcttcaaatggattgaagatcacttccggctgcctgaatgcgatttgccctttgccgatagcgccggaatgcgtccggacttggcagcgactatgctgcgcgcgattttgggatatggcgagaatccgttgcccgagatgacgagtcttgcggaagctcatggcattcgactatttagtctaccgactgtcggacgagaagtggatgctttcagctttatgttcgatggtgtgccgtatatcgcggtagataccagcaagaccgcagaacgtgtccgtttcgatattgcgcatgaaattggacatctgatgatgcatgaaatggtgtctgaagatgtagcggctgccggaacgcgcgatatcgaaggtgaagctcattcgttcgccgcgaatcttttgatgccgaagcgccgtgttctgggcatggtgccgactcacgcttcagtgtcgcagattttggctgcgaaacgatattttaaggtttccgcaatggctatggctcgccgggcctatgagctgggccgattgtctgaatgggaatatcggcaggtttgctcggaactgacggttcaaggatacaagagtggcgagcctcgtggcctgcggccagagcagtcgaaggtattccgcttcgtggctgatacgaacaggcagaagggcatatcggtttccacggtgagtgaggagaccgggcttgtgcccaaagaattgcatggattgtcgtttgggaatatttgggcggttactggtggaatggtctgagccagagagctatctcgaaccgaaacaaatccatttgaattagcgttacaaatctgtgctgacaatgactgagtataaccccttgttagttcgagaggtcgcttcactggatcccgtgagcttcgttggtctcgtttttggcttaatgatgccgttttcgcgaccctcgcgagattcgttgattgccgttgatttcgctgttctcaggggtcatcgtgtctgaatcgtgtctgagccacagacacgatgacgaacgtcattccgcgactgaagcaaccggacgactgaggaacaatggattaagccacaaccagtgggctcaacgtcgcaatcttcaacctctcttcaagaagtagtttatgaagcaaattccttccatgtgcctccgggataactgtctccccatatcggttcatcagttcgatgattgcgtcatagttaggtccatgcatggtcgtgtagcagaaagtcagctttgttttgcttccatacaaatcaacttgatcgaaaagcgactggaagtaggagtaatcagcctcccctaatgaatgtccaaagaatttgatttccttgatttcatctccattttcctgagcgtcaaagatagatctccctttcatttcttcaggtaggtattggttaggtagctctaggaccctcgcagtcttagtgaattgatagatttctggtttatccatgcgggacagaccgtctatgccaaatatcacatgatattctcgaccaaaagtttgactgtactcgtaattcccggtgtctccatgtacgtttctctgataataaattgaatcatctattgacttctcaagaagcggtgtcgtgtaattaaaagacaggatgacattagcttgttgctcaagaggaacacttgtgccgattgttgcaatctctttgtatgtgtttttacatcctggctcgtatgagggattatcttttatggttttgattaggtattttgcaaattcatcttctataatatgaagttctaatgcgaagaatttaagtacctgttcccggaatctatcccgctcttcatctaaggatggaaactctaagattgagaaatcaacacttggcagtttttcccgcagatgcttcttaatcatagagtatgcagctttgacttcgtcagtatgatcctctaccgcaagaccaccctcccaaaaatccattgcatcattgagacttatcgcatccttcccgacaacccattccttaatggcgctctccacgtctttccagtcatcaaggttcttggctgtgtcatgccaaacagcaaacagataatcccatatacaattaccgtcgtcaagaggatcgtcaatcaatttcggcatgagcaaaggaacaatacccttctcattccgatatttcctgtatctatagcggaaaaatgcaggataggatgacgggatatgttgcgctaaatcgaatccattacctaaaacgataatctgtgtatatgccaattaaaacctttcccacaagtcagcaatcaggacagcatctttggttcattagttactggaattaatggatagtttttcagcctttacctgtttaagttgttgactcaaactcgccagttttgccaaatgcccgtcttcctgataggtctcctcaatcaatgtatccatgaaactgagaataaattcggcatagtctttgctgatctcttcaaagatattgtgagttgatccgttaccgacatccttgattgttgctgcaagatctccgaggcgcttactgattacgccttccttggcggcatccctgagcttcgcgttaagagtcttgtctttgccatgttcattggctgggctctgaatcttttccgtgatgatgacttcgagcacgcttcgtgccataatcatgcctaccttcttaagagcatcttctatttgctttgattattcataatcttaaaggtgagtcaacaaaagcggattgacctaaccccacttcactttcaaaactcagtatgtatcccctcatctgttcgttcgtagagttcaccaatcggcgtgcagcctgtttctcatggagagtgttaagtatagaaagaacatccgcatccgcaatgcctcttctgagatccagcgtacattcaatcttaggaaccggaattgagtaactttcagtttcaacatcatgcaggatggccttttcacgcaaccacaatggatcgatattcctcgttatcagtactgtgtctcggctcgacatgcctgtttcatattccagtcttgcctcgtgggcatcggtgacgctcatgaaatagcagtcccatgcggcattccaggccttatgagataaatcatcaatggattcgttgccggaatacttaatcaatctgcgtgcttgttccgctcgattgccgttccccgtcaatatgtcaatggcgacctgaagctcatacgccgaggtagcccctaactggtcatttacccacgatacatattcagccagcatcattaagcgattatctgtattcatcttttgtgccaacagcattatctttagtaatgaagcataatgaatcgcgaactgggtgaagtcgctaattattccattaaacccgtatgccaatggatctatccgcgtctgatatggccggtctcgacattttttatcgcgattagcaagagggtgatgattggaaaattgtttttcaatcatcaccttatcccactgaagcattgtctctgcgacatagcgttttctttggaaattattttcatcgaatccagaacgccattggtgacacgactccaacaaagcgaatcctatacatggatctatcctgtttttatcaagatatagcagcaaatccttcagagactggcgctcctcctcgcttgtttgattgaagtagaaatgctccatatcaataacaacatttgtatctaatacagcacattttggcatagtgccatcatctgcctcggcggaaatcaaactatatgccccaattcgcaaaaggattcacatctcctaaactcgtaagttctttagctttctttgaattgtaatcaattccatgctcacaggcaattttgtcagcttcctctaatatatgatcctgtgaaaatggaacagaatacatattgactcttgccaagactttcttatttacaggacgttttgaatcccaaaaaaataagcgattccatcaaatcttggcatggctggttgattaacaaggcagtgactgattatttggaggtttgagtaccgggtgttattgcgaaacggcaccggtgttattgtgggccggcaccggcgtgcttgacgttggacgctgccggtgccgttcctgttcttttttttgggggggcggctaccggacgggcgcgtgttcgcacatgttgtattcgccggtttccagctaggtggtgttgtgtacgatccggtccatgatggcgtcggcgtgtgtatgtgttcaattggatgttgaggaaaaacactgccgaacccgcccaacaaacattgaagcaatacaatttcgcggctgaccgtggaggcgtgtctgccgatcaggccggcgatccgccgtatgcttgtcccgttgtcgatctctatctggatgatctgccgttcctcttccgacaggtgcgaatgcacttgacccaaggtgcgacaccctttcactggttatctggacaatctccaatttaaagggtgttgcacttctaaatagacaacgggcacaccctagtttaatggcgatactgctatgcttgggagttgctttcattgccataaaaagcaattgaattttcgcgtatttggaggagagatatggaatatcaagaagagcttgccgttgtaccgttggtgccggttgatgctactccaagtacggacactatgctgcgtatggttttgaatcatgaagcgttgttggttcatcatgtcttgaatgattccctctccggtcgtccagggcaggttgcccaggcaacgggtgcgttcgcaaaagcaatcagtcaggttactggcgaatttaatcgttccttttcaacggaaggcctttaccgagtagtacttccggccggttcgacagccaaagatctggtaccggctgtaggtggcggattccgaggcatggtcagggcagctggctccacgcgcatttccggtcacgctactttgcttccagttgcgggtattggagcaacagtagcagtgggaccgttgatcgcgactgtagctctggcaacagtttctgaaatgcttgctcagcatcagcagaataagaagcttgaatccatccagaaagcggttcaatctatacaaacacgcatgagtgatgaagatcgtgccgttcttgtaactgcggaacagcaagtgcaaaaagtgaccgggtatttgcttgatagggcttctattcccaagatttcgtccgctcctgcagcttttggcgatttgaatacgctagcgaatcggtggggtgaacgattagtacggtggactgagactgtacaacaatattcccacaaagatcgcgtgtacgggccggaactaatgctggctcttaccggtgagaaagagcacgcagaacaggcgttggagaatatggtggcgcaaacctatgaggcgttggcgttgcgcgctcgcgtcgtcgttttggaaaaggttgctgcagaatctgaaaatcagaacagatccttgcctcatgttgaagcagcgttgcgcgcagaattgtctgatattgccgctcaacagacacagctgaccgaattgattgatgacctgagtgcaatgccgctggactcttccaggttgccagtgcatgtggcaggtcgaggaatgattaatacacgcactagctttgcgcgactttcaaaggcgctgcattccacaccatcagcgttgcccattcttgatcaattcgatcgaatgatactggatgccgctccgactagcgacggtttgtcgattattacgccagaagaaaatacggtttcaacacctgaagcctgatggagaaagtcgttgcgctataccgggcgtctgttggagaacgtggtgttccttgaactgatgcgtagggagggggatgtgttcgtcgggcaaggcgtaggcggcgagattgatttcattaccaatggcgcgggcggccccgatactatcaggtgagcgaatccgtgcacgactcgcgaaccttggaacgcgaactgtcgtcgttgcgcgcagtaagggataactatccgaagacactgatcacgctggatgatgaacgcccggtagaccacgaggggattagacaggtgtatgccctggattggttgcttgacggtaatgagtaaagcagatataagccatggctgggatgttgcatttggtgcggcatcccagccaacgcgtatcctgaagtattcttgtgctgagttatgaggagggctgatggctggttcgtatggtacggaggattcgcagaatgagcgctatcggttgtcgttcacggtcgggggattgctcgccgaacaggggaggattatcgccgcgctcttttctgggaaccgcagcgagcatgtgaatcccgattcgaaccccgcgaacagaacaacagaagcgaaacacgaaatcggggaacgcataacccgcatccgcaagcaggctgtcgaagagaacgtgctctccatccgcacccgctcggcgaactcccgcgttgtcagcgaggtattgaaacggctgagcgcgctcaccgagacggaaatccactacctggcagacgatgacactcccgcgtcggatcgtcaggcattgatgtgggtggccatgtgccggtattacgcattggtgggagaattcgccaacgaggtgctgcgtgaacggtatctgatgggattctcaacgctcaccaaggatgactatgaccggttcatccaagcccaatcgatgtggcaccctgaactggaggaactcagcgcgctcaccgccggcaagctgcgctccaacgtgttcaaggccatgagcgaggcggaattatgggaaaaggaaagtgacacgctgctgccttccctactgagcaagtcggtgaccgctatccttgaaaacaggcccgaatcattccgattcttcccaacgcgggaacgatgagggacaatcagggcaccggaacgcaagcacagacagcttcatacaagagcgcatgaggagagacggatatgacgaatcccgatgacgagatacgtcggcatccacgcaccatcgaacaagacttcgaagggctgttccgcacgatgcgaagcaaacgcttccgcaatggagaagacaccggtggcgagccggcgaactacatctacgcataccctcccgaacaggaactggaagtagaacgccgaatccccatgctcgtgaaccgtctgcaaagcatggatcccgtggattccaacgattctgcgcccggcgtgctggtcatcgatttgtacgaaacagtgatccacatcatgcaggataatgacatcctcgaatcggtcatcggtcaggaagccgaaatgcacggcggcgaaaatgccgataatatcgatggcgattcggacgaatggccgcacctgcaggaggacgacttctatcaggcgctcgcaggcatgttcgatgtggatgcgggcgagctgaaagatgccctagcgaaccagtaccaagatgcggcggcggaacagcgagcccacatcgtgttcctcaccggcatcggccatgtgtacccgtatatccgcgcgcacgccctgctgaaccttatccaggatattgttcccgccaacactcctgtggtgctgttcttccccggcaaatacgagaaaacggcgacgaccgtctcggtgatgcgcctgttcaacaccttggccgcagacaattactaccgcgcctttagcctcaataccatgattacggagggagccaactcatgaacgacgagttgcaactgaagcagatcttcgtcaagaacatcgatgagaagatcgatggtgtggtcaaggccagcgatgacagcaaaatcgccgacgaggtccgcgaatacgtgctgaccaacgagatccagaccaatctcgaacaattcctcgacacctacaacgatccgacagcggattacaccaacggcgtatggatctccggcttcttcggatccggtaaatcgcacttgctgaaaatcctctcccacatcctcggtgacgcccccacccaacacagcaccgatgacaacaacagggagccgatcacccgcaccgaagtcatcgacaacatgaaagccaaggcgcgccaggctgaaaaccacgaacttgaagggctgctggacgccaacctgcgcattccggccatgtcgctgctgttcaacatcgacagcatctcgcaaaaaggcagcaaaaccgcgctgatggacgccttcatccgcgtcttcgacgatgcgcgcggatattacggcgccaacaaatacgtcgccaaactggaacgcgacctcgacaacaacggttgtctcgaacagttcaagaccgagttcgaacggctggccaacaagccctggtccaaaggccgtgcacaggccgcattctccggctccaaaatagaccaggcgttcacggcggcaaccggcaatgaggcccgcgacatcctcaaggattaccagaagcaatacaaccccaccatcgccgacttcgccgatgacgtgcgcgactggctgcagcggcagccggacaacttccgactgatattcctggtggatgaggtcggccagttcatcggcaccgatatcgaccgcatgttgaacctgcagaccgttaccgaggaactgttctcccgcaccaacgggcgcgtgtgggtgatcgtcacctcgcaggaagacatcgacgccgtggtcggcgaccgtacggtccgccaaggactggacttcaccaagatcaaaggccgcttcgccatcaatctgaaactctccagcgcggacgccatcgaggtcatccagaagcgactcctgctcaaaaccgaacagggcgaagccgaaaccgaagaactctggcgcaagcatcacgacgaattggacgccctgttcaccttccaaggcggtggcaacacacgccaattccgcgacaccaacaaattcggctcaaaagaggacttcaccgccatctacccactcatcaattacgagttcgcgttgttccaagcggcaatgcgcggcatgagcagtgccggattctttgaggggcagcaccgttcggtgggagagcgctcgctgctggccacgatcagcagcgccttggtggattacaaggacaagccggtcggcacgttggtgccgttcagtgcgctgtatgagggggtgtccggcaccatccagagcacggtgaaccatcgcatcaatcaggcaccgcgcgagctcgatgcgcaaacctgccgttatgccctcccattgctgaaggcattgcttctggtcaaacacgtcgaaggcttcacagccaacgtacgcaatctgcgcattctcatcctcgatcggttcgatgagaacatccctgaactggaacagcatatccgtgatacgttggacacgcttgaacgtcagaactacgtgcaccgcaccggcgacgtatacgagtatctgaccaacgacgaacaggccatcgagaacgagatcaaaaacgtcgatgtcgaggaccggcagatccgctcccgcatcggcaagatcatcagtggcgacattctcggctctccgcaggtgaattacgggcaaggccggcagaagataccattccgctacggactgtccattgacggcatcgcgcaaagcacgcaacgccccataacgctgaacatcatcacgccgatggattccgccgaacgggatgccaagattctccaatccgcagggatacgtgacgaactgcgtgtgattcttgatgacaatccgctgcttctccgtgatatctatacgctcgaacgcaccgaaaaatacttgaagctgcacgccaacgagcaaggtgcacgcaaacgcatcatcgataacaagcgcgatgaccttgcgcgtatgcaggtcggattgaaagcaacgctgtccaaggcattgtccgccgccaccctggcctacaacggtgcgacgctggaaacaacagcccgcgaggatgcggcaagcgtcgtgacagagggattgcagacgctcatcggtcgcctgtacacgaatctgggcatggtggatggcctggcttattccgaaaaggacttgcctgtcgttctggctgatgcagatgccaacgccgatagcgcaacgctcgcagagaccgattcggtgcgcaacggcctggatctgccggctcaggaagtctgcgattacgtcaccggtgagattcggaaagatcttacgccgacggttcgtagcattgtccagcattttgaaggtgtgccgtatgggtggccgttggcggacaccttggcgtgcctgtgccacctgtatggtgccgagcgtattcatcttgtgcttgatggcagccgtgtgccgcgcacggatgtggtcaagtatctgacgaatcagaaaaagaccgagagcatgggcgtggcgattccaaaatcgtatgattccggaaaactcaaggaactgcgcggctttgccggcgactacctcggcctgacggcaggcaaactgccggccgacgccgaggagatggcacaaagcattaagaacgggttgaatgcggagatcaccagaatcgaagcgctgagaaatgccaatggccggttcgcgttcgtcgcgcaacttgatgaacctgtacggcgtctgcgtgcggtggcttccatgcccgatgattggattctggaatccttcccgaccgagagcgaggagatcaacaccgatcggctgctcgatgataaggaagagatcatcgacccgattcttaaggtgctcaacggcgtgcagcggggaacgctggtttccggtttggactggatcacgaccaacgactcgaacttcacactagcctctgccaagattcagaaggaacgcgacgaggttcgagccatcgctgatgaccccatgttgttccgcggcaacaaggtcaacctgttcaatacgcgactgaccgtgttgaaggaacatcttgaggcatggataggcgaggagcgggaacatgcgcttgaggtcgtgcaaaccgtgcgcggcaacatcattggcatcgattcctaccgcaacgcccgcgaggatgcgcagcacaatgctttgcatactttggaaggcgcggccagcaagatcaacgacgcgaagtacatcgccgacatccgtcagaccgccgatacggtgaaaggcaatctgtacctggcactggtcaaccggttggatgccgcgaggcaacaggcggaagttcagccagatgccgtcgccgtccatgacggtccggtcgtctccactgaatccgtcgagagtggggatacggagcccaagcatgtcgatgtctcggttgagccaaccgcacaaccggtaaaccgcaacatccgtgtgaccccgccccgaccgaagcccatgctggtcaccgaaaacgatgtggacgagttcctggatgaataccgccatgagctcatcgccgccattcgtgctggaaagcgtattctgctatgaacacgaacaagatgcagtcgtttgccgccgaggcgcgaacttcgctgatgaaggcggttcgcgctcgcatcgacctgcaccgcaagtacaacttcatcaactacctgccggcctacatcaacatcaaacatcccggcggtgggttcgacctcaccgggaagatcaaggccaccaacttcgtgcagaaaaagaacgaggagcacgccaagccagaccttgtggccaagccggtcgtgaagctcgcgcaggcagagacttttgagctgaccgaggccaaggaggagcggctttcgcagatcatcgccgagataaagaggcaagtgctcggcattttcaccgacgagatctaccagagcctcagaagcgcgtaaggagcttgccatgttcgaccgttttcgcctgaaggaagtgctcgtagagtacaagaaggacttcgtcccaaagcagtggggcgacgagaagtacaagtgggaggccgtgaagcacttccaggacaactgggacgtgaacgcgcccgacttcgccgacatgctcgagcggtcgctggccaagaccgataacctcctggcatcgatgaacaactttccggcgaggatgatcgggggcttcgctaagaccgcgccggaagaggtgcgctcgatgttcatcgcgctcttcgacgagagccgggactactacgagcgcgtggacgagtttaagatgcagtcctcgatcctgctggagaagtacggcaacggcgcgggtcagcactaccagaccgaaaacgcagtcaccacctacctgtggctgcgctacccggacaggtactacatctacaagttcggcgaggtgaagaaggccgccgaagagctcggcgccgactaccgcttcaagaagggcgcttacgcagacaacgtacgcaatcacctcgcgttctacgacgagctgtgcgaggcgctcaaagccgataaagatctggccgccatgctgcgctcacagctcactccggattgctaccccgacccggagctgcgcacgctcaccattgatgtcggcttctatatcagccgctacgtcgcgggcaagcaggatacgcccgcagccgactggtttcccgcgaaagaggagtatgatcccggcctttccgcagatgactgggaggcgctgctctgtgacgagtcggtgttcaccgagggcgcgctcaagatcgtccgccgcctcaaggactacggcggcgaggcaacctgcaagcaactctccgtgaaatacggcgagtcgagccagttctacctgagcgggtcggttggccttgccaagcgcgtggtcgagaagacgggctgcccggtactcactgatgacaacgagaacccgaagtggtggccggtgctctacgttggccacaatgcgggcaaagacgaggacggaagtttcatctggcggctgcgcgacgagctggcagaggcccttgactgcatcgacttgacccaggttcgcctccgtgctgaggccgagggtggcgaggacgatcgtgggtactggtggctcaacgccaacaccaagatctggagcttcgccgacatcgcagtcggagaggtgcagtcctacacgctctacaacgagaacggcaacaaacgccgcatcttccagaacttcctggacgccaaggccggtgacatggtcatcggatacgagtcgacccccgtgaagcagattgtcgccatcggcaaggtctccgccgagcaagatggcgagaggctctacttcgagaaggtcgagggcctctccacgcccattgactaccagaccctgcacgactgcccggagctggagaagatggagtacttcgtcaacccgcaaggcagcctcttcaagctaacgcccggcgagtacgactttatcctcgacctcatccgtgaggagaaccccatcgtcgaggagacgaagaccgagacctacaccgaggacgatttcctcgaggacgtctacatgtccgaagagcgttatgagcagctggtggcggttctgcgcaacaagaagaacatcatcctgcagggcgctccgggcgtcgggaagaccttctgcgccaacaggctcgcctggtcgatgatgggcgagaaggacgacagccgcatcgagttcgtgcagttccaccagaactattcctacgaggacttcatgatgggctacaagcccgctggcgaggggttcgagctgaagtacggcgtgttctaccgcttctgccagaaggccgccaaccagccggacaaggagttcttcttcatcatcgacgagatcaaccgtggcaatatgtccaagatattcggcgagctgctgatgctcatcgaacgcgactaccgaggcaccaaggccacgctggcatacaacggcctgtccttcagcgtgcccaagaacctctacatcatcggcatgatgaacaccgccgaccgctcgcttgccatgatcgactacgcgctgcgccgccgcttcagcttcttcgagatggagccgggtttcgactccgagggcttcgtcgcctaccagaagtcgcttgacaacgaggtgctcgacgagctggtggcgcgggtcaaggagctcaacgccgagatagcacgcgaccgctccctcgggcgcggcttctgcatcggccacagctacttctgcgggcgcgacgttgccgacgaggaatggctgcgcgaggtcgtggactacgacatcctgccgatgcttaccgagtactggttcgacgacgaggccaagctgcaccgctgggagaacagcctgcacggggtgttccagcgatgatcaaggacaagagcatattcatcaagaacgtctactatatgctctcctacgcgttccaagacctgcgccccgaccgcgaggacgatgtcgcgggcgaggatttcgagcgcatccacgacctgttcgcgtccattctcgccaagggcatcgcccgccagctcaagcagggcctctaccgcgagtacgtgaaccacgtggaagacctgtcggtgctgcgcggcaaggtcgagatggcgggaaccatcaggaaccggctcgcccgtagctgccgcgtgtcatgcaaatacgacgagctctccgaggacaatctgctcaaccagatcctgaagacgacggccatgttgcttctgcgccgcggggacgtgagtaccgaacaccgcgacgagctgaagaaacgcatactgttcttcgccaccgtgagtgaggtggagcctgcggacatccgctggtcatccatccgcttcacgcgcaacaaccagagctaccggatgctgctgtcagtgtgccagctggtcatcgacggcatgctgctcaccgacgagcgcggcgagatgcgcctgatgacctacatcaagccgcagtacatggagcgtctctacgagaagttcatcctcgagtactaccgcaaggaatgtggtctcgctcaggccagctccccgcagatcaagtgggcgctcgacgacgggataggcacgatgctccccaccatgcagagcgacatcgtgctttcgcgcggggaaacggttctcatcatcgatgcgaagtactacacgcatacgttgcaggagaactgggatactcacaccatccactcgaacgacctgtaccagatcttcacctacgtgaagaacaaggaggctgagcttgcgggcgggccgcacgaggtgagcggcatgctgctctacgccaagaccgacgaggagactcagcccgatggcgtctaccagatgagcggcaaccggatcagcgtgcgcacgctcgacctgaacctgcccttcgaacagatcgccgcccagctcgacgctatagccgagcagcacttcgccaaggaggcggttgccgtatgagggagattgggctgtcaagaacgatttaacgtttccctgaaccttttaacgattcctatttgagagagcgaggtgggtgcatatgagaacggcaacaagaacagtcgagcggagtaaagccgaggcacttggtgcgtgggcagctctcgccagttgtctgctggcaactgaagccgcaggtaagagccgcgtttctgctcagcacagcaccgaccccgcaacagggctttgtatcaaagacggcaacttgttagactccacctgtggttctggtcatatgttttcttatgccttcggccttcgctacagcatctacgatgatgtcggctactccgtcaacgaaatacccgatccgattctgggggttaattcatgcgatagcatggagaactggtctctgcataacgaataaggttcggcaggagaaaccgagagacgttttcacgattatcggtgtggatggacgtaaaggaagagccaaagcaatgaacacgaacaagttgcagtcgtttgccgccgaggcgcgaacctcgctgatgaaggcggtccgcgctcgcattgatgccgcactggagccgaattctttggctcagtccgacagcccgcgtgcataccgggaactgaccgaagagatccagcgcaacggcggcggtgaacagggcagggcaaagaccgccgagcgtcatgcctaccgctggttcaaccgcatcatcgctctgcggtacatggacgccaacgagttcaccggcgtgcatgtggtgtccggtgaggaactggataatccaaatgcgctgcccgcagtgctgtcggcggcgaagcgcggcgaattcgaggatgagatattcgggggagtaggcacaaaatcaaaggtgctgcctactattcaggcattgcttgacggcggcaagcccagcaacgacccgcagggagacgcctatggtctgctgttgcgctcctactgcgattactggcacaagtgccttccgttcatgttcgacgacgccggtgccgccgatgagatcctgatgcccgccgacctgcttgccaaggattccgtgctgcgcaaggccgtcgaagtgatgagcgtggccgactgcgtgggcgagagcgatgagggcaacgtcgagattatcggctggctctaccagttctatatctccgaacgcaaagacgaggtcatggccggcttcaagaaatccaagaaggccggagccgacgagattcccgccgccacccagctcttcactcccgactggatcgtgcggtatttggtccaaaacaccgtaggccgcctctggacccagaaccacccagaatcccaactccacaacacctgggaatactacatcgacccggttggggaagacgccggagagatcctcaagatcgattctcccgaagacctcaccgtctgcgaccccgcctgcggctccggccacatgctcacctacgccttcgaccttctctacagcatctacgacgaagccggctactccgccaacgaaatccccggcctgattctggaacacaacctcttcggcatggagatcgacgaacgagccgccaacctcgccgccttcgccctcaccatgaaggcccggggcaaataccgccgcttcttccgcaaaggccgccaagtccaacctaacatccaacgcatcacaccggaacgtttcaccgatgacgaagtcaccgaactcaacgacctctaccacgtgaccttcgacaccgacacttggaacacctaccaaaacgccgacacctacggttcccttatccaaccgcccacagaattggcggctctagcctcagccccctctgacgagggggctgggcggattctagtggtggttgcaacacctgaggtttgagcggccttccatggtcacgtttgaccatggaaggccgctcaaacctcaggtgttgcaaccaccactagaatctgccaaactggcttggttatggggtcgctctacactggcttctgctatgcattacttcacccctaaacgttgcgctacgtcgaataaaatcatgtatcacgataaggcgcaggttcagcgtgccgctgatcaaagcctaatcgagcgcggagttgagctatgggtgtaccgttgcgaattttgcggatgctggcatctcacgcatcgcgatccgcaatccagttaccggcatgtaccgctgaaccagcaactcaagccacacagtcgtaaaaagggctacaagccacgtagacgttagcgtcagaagctccacagacctcgccaacgccgtgtctgagacaggttacggtccaaacacgtcaggtcgtaggctgctaagcgttcagggcgctcggacacacttcgtccaacacttacatcaccttggtgttttcaaggttgcggataacccaatcgttgaagcgaattaccggcttgcgcaacataagtcccaacagcaatgaggggacaaggaacagtgccagtttgcccatggaaacccagtattccatgccgaatgagcctgccatggccgaatgcatcgcatccaccgcataggggaacagtagccatttagaaacgacctggaagaacgtcggcagtgtttcaatggggaatgtgccgccggaaccggctacctgcataaccagcagtactacggcaatggctttgccgatatcaccgaacgacagggtcagcgtatacacaatattcgagaacaccagtgcagacaaccacccgaccatcaagaactgaatcggatgctcacactgcacgccgagatagaacatatcgcccaggcacaccagcgtaccttgcagcaaagcaaggaaaccgaaaatcatgtatcggccgaaatattcgtggtgcaagcgtaaaccgaactgccgcgcattgccgggagcctcggcacgcggcttcttcagcacatccaacgcggcggccggtccggcaatccgcccggcaatcatggcctcgcgaagacccacttccgaaccgagcggcagatcattgcccaaccctaagatacgagccttctcatggtcggaaatcgatactttcaacatggcgaccagaatgatcgcaccgacccaaatagacaaaatcgtgtagaacggagccatcgcggaaccatagttggcaacgggatagagcgcgatgcggtcgaccgctacgggtgccgccagcatggaagcaatggcatcgggcttcgcagaggaaatcacagacaggtcgatggtgccgccattggtgatagaggcgagttgggaagacaagttgtcgagtttcttcgccgaacgggtcaaagcgctagctgcgtcagtcaaggccgactggatgtccgtcaggctgtctgaaacgccgccagaaagacctgacacgctgcttacggtcgatgcaagcccgtcgattacggaacttgcctgcgtggtcacttcgtccatggacgaggtcagattgttcagttgcggtttcagcgtgctcttgtacgtgtctgaagcctgagtaatcgattgtttggcggcagcgatttgtgatttcagatctcgacgcgctgtatcggcatcggcagtaccgtttgctatgtgcgtggccgcatcgcccaacgcggtggcggcttgctgcatgctctgctgcgcctttgtggcttggtctgcagccgcgttcagttgagcggcaacggtatctccgcccacgggcagtgaagccgcttgtttggcgagatctcgtaaagcggcggcatactttccaaagctgtcggcctgagcctccactttggattgcatatcggttagcttgtttgatatctgtgaggattgtgagcccacatcggcaaaagcggcatcgatttgcttggcaatggtgtcgtaggatgaaccggcctgctgcaatgccgtaccgacgccatcggtggctccggacaatgccttgtcgaggctggagacgccgttgcgggtctgtttcaacgcctttttggttgtggccgcagctgagcctgttgatcccagcagcttatcggtggaatcaatgatgctgttggcggccccgagcagattggcataggaatccatctgcgacgcagtgccggtcaaacgagacgacatggtggcaatatgactggaggcgttgttgacgtactgctccatttgcgggctttgcgcgtaatcggccacgttggaaaccaaatccagcgccacgctcgccaaggtcttcacaaatgtctggtcgatggtcgtggccacggtggtagcaccctggtcggtgatatgcggagcgatcggattgattttctcattgagatagtattcgagcttggcgtgcttgatcttcggtgaaaacagcgtcatcatatcggagctgaagctctttggaataatcagcgcggcatagtattcgcctgagttcacgccatcgatggccttagcacgatccacaaactgccagtcaaggtcatgattggccctgagcgtattggtcacggtttcgccgacgttgatggtgatcggcatcagatcggacttatagcccttatccacgtttgccacagcgaccttcaaggccttggtgttgccgtacgggtcccagctggcggcgatgttgtaccaggcgtacagtgccggcacaatcaccaatcccatagccacgattacggcgatcacattgcgggtggcttggcgcacgtcacgtacgaatattttccagataagcttcatcgtgcgcctccttgcccagactgcccagactgcccagactgcccagactgaccggactgtgcggtgtgcgcagtcggctcggcggcctgatcgccgaacagtgtgagtcgttcagtggtttcgccgatatccggattgctgcccatcgccgcttcgtgacgtccgtggccgtggaaacgccgccacacatatccgttgagcatcacattgcggaactcgtcggcactcatggcactgacgccaagctgcatggcgtaggtttcgcgtgcgtattcaaccacaatgagataggcgtcgataagaataatcgacagaatccaggaggtcagcatggcgattttctcttgggtgacgaacagcagtaccaggaatacgaacgggagtacggtcagcaatgtcagaccggcaacgatcatctttggataccgtgcgaagaaccggtgcgcgcgatgggcgatgatatcgcgcagttccttgctgtcggacaccgtgcggaatacggagttcaagctcacctgttcgttcaccatgctgttgtgctcggtgatcatcaggtcggtatctcccaaacgacggtcgaacagcgcgttcaggttcatcgcataccggcgtatgacaagtcccacgaagagtgccgccggcagataccagaacaggtgcagcatgtcgagccagtaatggttcgcgtacaggccggcaatcgggccgcgcatcgcgttgatgccgtaggtaaagggcagccacgggtgcagttcgcggaagaagttcggcatcatttcaatcggatacaggccggaggcgccgggtatctgcacaatgaccagaattacggcgatggctttgccgatatggcggaacgccacggccagtgcgtaaataatgttgatgtatacgaacgaacagaagatcccggccaagatgaacagcagcggatgctcgcattggatgccaagcaccagatcgccgatggtggcgatgacggcttgcaggaatccgatggtgaccagcagcagccagcggccaagatatgcttgcgtagcggtgatacggcgaatgccctcgcggtcgacctcaagcttgtagatggcgattagcacgaaaccgcctacccacagtgccagattcgtgtagaacggggtgactgcggacccgtaattgtcggtggcatacacgactttcgtggtcagggtgacgggattgcccatgaagtcgccgaatcccttgtcatccagatgcagcgtatcccggattttctggtaagcggcggaactatcgagcgtggcgatatcggtgcgtacggtggcgacatcgctggccacctggcgcagcgaatcctgcgtgctgctgatggtggtttttgtttggttcagggtatcgacaagctggtcgaacagtccgtcggcctgatccaaggtgccggataacgaagtcaacgtgccatccagtgtgccattcagggcggcgaaactgttcaatgatgaggtgagcgacggcattacggtgccggtcagcgagccgcgcgcggtattcagcgccgcgatgccgccggtggtggtgttggtcatggctccggaaagattcgtggtggcgtctttaccggagttgatgaactgtgtggtgtcggtatggaaggtgttgagctgtgtctgctgtttgctgatcaatgagtcgagcgcatcgatttgtttccagatgttctggccgactgggtcggtggtgtctttgccgatgccggctttggtcagcgcgtctttcagatcgctgattgacgtttgggtggcattcagtggggccgaaagtgtgttggtgatggtgtcgacggagttctgcgcgctgttgaaggagccggtgatgctgccggcggcgttgttgacgtgaacggccagtccggagagttgtgctgaactggtgtcgagcgcgccgaccagtgtggtggagaaggcttgtgacccggcctgtgtttccgtcaacagtgtgccggactggcgggaggccttctgcgcggccgcgacggtctgcttgagtgaggcggtggtctgtttggcgtcggcgagaatcgtgtctgattgggccagcgtgtcctgtaagtcggtgagtgaatcctgaacggtgttcagcgtggacatcaccgtattgagatcattgatcgtatcgtgctggactttgccggtggcttggtcgagatcgcctcccgcttcggaaacggccgaggcaacggtggtggctaccgtggtgacgaaggcggagttgatctgctcgtcgatggtggtggcaccggtgtcggtgattttcggcgcgatcgcgttcttcttctcgttgacgtaatacttgatttttggctgtttggaggttccggtcaccgattcgaccaggctggtgctgaaatccttgggcagcacgatggctgcatagtatccgccggtctccacgccgtggacggcctgttcctcattgtctacgaagcgccagccgagttcgtcgttctgcttgagtttcttgacgacctgccggcccgcatcgagatggccgaccagatcgttggtggtgccttggtcttcattggctacggccacttgcagattgccggtggctgaatagggatcccagttggcgagaatgttgaaccatgcgtacagcgagggcagcattgctacgccgagcgtcaccacaacggcaacgggattgcgtaagatacgtctgcaatcgcgtagaaagacttgccaaaccgtccgcatccagtccctcttttccggttcgtaatcattgcggccacatgcagtctattcccaccactggtgcgaatactgctggtttggcgggttttcttgcaaaactggccgttggttgtccgcataatgggactgatatgtgaacgtttgttgatggtgcgacaccggcgggatggttgtgcaattttgccggtatccggtgatgaaatgttgaggtgttggaactgagtcgtcgcagtgctgagaccgagacgactcagtgacgagcctatccgaggctatctcgttggttctggtctcactgatccagacggaagccctgagcggcggccttgtcgagcagtgtctgatggctgacatcctgccgactgatcgtggcgacctgatcgctgaaagcgtccaccggacggtcggcttggcgcagatcgtagtaccggtgaacttcctcgtcgaaggcgggcagctggtcgagtacgccatcggcgtcagccgggtaggtgttctcgaagaactgcatcgtgcgcggcatgcgcggcttgacggtcgggttctgatcgggcttgccgatggccagacccagcaccggatacgtgtattccggcagattcagcacgtcgataaggccggggatgttgttgagcagagagccgagaatcacgcagcccagtcccagcgaataggcggcggtctccatggcgtgcagggccagcactgcgtcgttctgagcttgggtgaagcgatagctgtacttcagatggaattcgtcggaagcgggatcgatgcccttgcgttcggcgatgcgcgcgttgcggtgctcgtcgataacgaacacgtacagcaacggcgcagtggcgatatacggctgatggccgaattcggcgagcttggctttgatggccgggtcgatgatacggatggcggaccagtcgttaaggaactggctggacgcggcatgctgggcgacggtttcgagcgtggcgcgggtatcgtcgtcgatggcctcgtccttgaacttacggatggagcggcggcccagaagagcctcgattgttgcgttggtaaccatggttttattgtcgcacggcagacgccggacgccacggtggattacctcacagtgaaatgccgatattgtgtggcggaactgtgctggactgatggttcctgtcgattgactgatggttccttgacgaaaatccagcgatgagccatcagtcaaccaacagaaaccatcctccaaccgggggattagcggctggacttgcgatggcggtggtcgacgaacgccttggagccccgatccgacagctgcgaaaccactgcgccgagtgcggccgaaacggcggcgaatgccagactcattgccagaccttgcggcgcgtctgccgccagtcccttgcgcagattgcgtttgctcgtgcccttgtcccatatcatctggaatgctttgccggcaaccaagcctgccagcgctgggactgccgacttgatgagcttgtcgcccagagaatcagggtcgttgagccggtcctcgcgcagcctgttgaccttctcgtcgatgcggtgcaggctgtcgaccgcacggtcggcgctggaggggaagtcggtgttcgtttcgtcgctcatgactctcagtctaatagcatctcaatcatctcagcgcaaaagatgggcgttaatggtggagtcatgaacgagcgcagactagagtggaggcatgagcgaacagaacgtgaacggcaccgttgccgtcgagaactctcgtggcggcaacggatttttggtgttgctgcgccacggccagaccgtgtggagcgaatccgggcagcataccgggcgcacgaacatcccgttgaccgcggtcggcgagcagcaggcagcggatgccggaaggcgcctgcgcgaagctttccccgaaggattcagccagggctgtgtgttttccagtccgctgaagcgggcgtgccaaaccgctgaactggccggttttgcggaccacggtgtgttggacggcatcgctgaatgggattacggccgagccgaggggcgtacgcgccagcaggtgagtgaggccagcggttttgaatgggatgtgtggcgtgacgggccgcgctcgctgacgcccacgctggagggcgattgggtcgagaccttaccttcgggcgagcaggtgccggtccatgccgggcctggcgagacgctggaagaagcagcggtacgcgccaagagcgccatcgatgagattacgccgctgctgaaagacggccataatgtgctgttggtggctcatgcgcacatcctgcgcatcctcacctcgcaatggctgggcgtggacccgcatttcgcgcggttgctgcgtttggatacggcgcactactcggtgcttagcgtctataagggagataacgtcatcgaacggtggaacgcctagccccggttgcgctgtgattacgctggcctgcccgctgctgcgggcgggcctttattgtttgtggtgggaattgcggtatgtcgataaatgatttgcaaacgatagcgtcgccgtgttgttttttttgatgggtataagtggcaatcgattgccatgaaagatatgttagcgctctcataattgcgaacgcttgcattgcgataatgaggcaaaaatgaccgaattaatgggatatttgttgacgatggcctgaaaatgatgatttatgacgcgccgatattgctatcgtttgcaaaaagaagcaaaccgttgcacaatagtgcatgtcgatagtcataaaggtgcgtgttagcgtacctgtcctgaccggggacggccggggtcgacgatgaaagagaaaggttcgatgatgaatcgtacagtcaagtcagcagtcgcgatggcggctatcgctgcgatgtccctcggcactttggcggcctgcggaagctcgacctccggcgatgacgccaagggcaaggtctactacctgaacttcaagccggaagcggctgatcagtgggccgctctggccaaggagtacaccaaggagaagggcgttgatgtcaaggtccagaccgcggcctccggcacctacgagcagaccctgaagtccgaaatcgccaaaaccgaagccccgaccttgttccaggtgaacggcccggtcggctaccagaactggaagaagtacaccgccgacatgtccaacacggatgtgtataaggaactcaccaaccaggacgtggccctgaaagacggcgacaaggtggtcggtgtgccgtacgtgatggaaacctacggcctgatctacaacaaggacatcctcaacaagtacttcgcgctggatggtgccaaagccacgtccatggacgaaatcgacaacttcgacaccctgaaggccgtggctgacgacatgcagtcccgcaaggacgagcttggcatcaagggcgcgttcacctccgccggcttcgactccagctccgactggcgattcaagacccatctggccaacctgccgctctactatgagttcaaggacgacaacgtcaccgagcagccggccaccatcaagggcacttatctgccgaactacaagaagatcttcgacctgtacatcgccgactccaccaccgaccccacccagctgagcgccaagaccggagatgatgcgaactccgagttcgcgctcggcgaggccgccttctaccagaacggtacctgggcctggaccgacctgcagaaggccggcatgaaggccgaatccgtgggcatgatgccaatctacaccggtgtcaagggtgaagagaagcagggcttggccactggttccgagaactactggtgcatcaacgacaaggcctccgacgccgacaagaaggccaccgaggacttcctctcctgggtgatcacctccgacaccggcaagaaggccatctctcaggacatgggcttcaccaccccgttcaagaccttcgatgatgtcaagtttgacaacccgctgaccgaagccgccgtggaagaccagaagtccggcaagacccaggtttcttggaacttcaccatgatgccgtccgaagagtggaagaacaaggtcggccaggcactgctcgagtacgcgcagggcaccggcaagtgggatgccgtcaagaccgccttcgtggacggttgggcttccgaatacgaggcttcgcactgagtctcatagagtcccatagccgataagtaacaatccgcggcgcccctgccatttccttctccgggggggcgccgctttgtattgctgagtctcgcacaaaatcgtccgccgcaaaaaagtgtgaggcacgcacccgctcaatcgcacactgtggggccatgaatcggcgatttttcgccattctccacaatgtgcgattgagcgttactgtgcggttgcctcacactttttctatggtgggctttgttgtgtgagcctacttaacgcgggaggtggaggagcggaccttcagctgggccgggaacacgatgtagggttgctcaatcggcttttcgtcaatgagatcgagcgtcatgcgggctgccacgcgggccatttccaccggatcctggcggatggtggtcaggccgatatcgccggtgtagaaactatcgtcgtagccgatcaacgagacgtcgccgggcacggagaatccattgcgctccagctggaacataagcggcaaagcaatgccatcctcctggcatgcgatggcggtgggcatctcgtcttggcttatgagttggttgaccacgtcgctgatttcataacgtccatcgtcatcgaccttgcagacgataacctgcggctcgatgccttccctgcggcagcaggcggtgaatgagtcgaatcggctttgcacggagaagctcagcgacacctcgcgattggtgctgatgtaggtgatgcggcgatgtccgagattgataagatggcgggcggccagcgtggagccctgcacatcgtcgatattgacggcggcggtaaagccgcgggctccgggttcgactgaattgatgccgacgatcggcacgccgaccgaagccagttgcgcgatttcgttgttgtcgatatcgaaagacgccacaatcacggcatcggcgttacggcgtaccggcaacatctcgaagaattccttgcgctcctcgatgctggaaatctggaataccgaaatatcgtagccctgcgtgtgcagcacctcgttgagcccctcgatgaccgaggcggtgaaccacaggcggatatggccgctcatcagtactgcgatgcgcagggagcggccggatttcagggccgcagccgagcgggagagtgagaaattgagtttgtcggcgatggcgagcacgcgctcgcgggtcttggccgacaccagatccggcctggtgaaggaacgtgagacggtggagatggagacgccggcctcgcgggcgacatcctgaatgctcgtagccattgcagcccccttgcgttgaatggaaaatcgcaatacacatgcacaactgactccagtgtacatgctgattgattgatctgcggcgatgacaacgattgtattacaaacgtttgcaaagtgtctatgtcggcgttagattggctttatatagccattatcttaggtgaaagaagattgctggagccggagtgtgctcgaacttgaaacgcctaaaatgacaacgtttgacatataatgattcgacgtttactatgaacataggcttgaacgagaacaggccgtgcatgcggttctcgatcggcaagctcgcattgagttgaactccgcagccggcgcacgatgcagtgtcgcaacgcagcggactcaaggaggaggaaaagtcatgatcagcatggctggcaaggcgatacgcaggtggtgggcgctgttcgcgcttcccacattcgccgcattcatcatcgggttcctagtgcccttcatcatgggcgtctacttaagcttctgcgaattcaccaccgttaccgacggtgaatgggtggggcttaagaactatggcaaagcgctgaaggacaaggaattcctgcacgcgcttggattctccaccgcgttcaccatcgtgaccaccattgtgatcaacgtggtcgccttcgccattgcctacatgctgaccaaggcgatcaagggctccacgctgttccgctcggtgttcttcatgccgaacctgatcggcggcatcatcctgggctacatctggctgctgctcctgaacggcgtgctggcccactggggtcgcgccctgacctataaggcatcctacgggttctggggtttggtcatcctggtgtgctggcagcagatcggctacatgatgatcatctacattgccggcctgcaggccctgcccaccgatgtgctggaggccgcggccgtggacggcgccaacggacggcagaccatgttccgcatcatcatcccgctgatgatgccgtccatcaccgtgtgctccttcctgaccgtgaccaacggtttcaagctctacgatcagaacctcgcattgaccaacggtgcgccgagcaacatgtctgaaggtctggcgctgaacatcacccgcaccttctacggccgtatgggctgggaaggcgtcggccaggcgaaggccgtgctgttcttcatcctggtcgcggtcatcgccctgattcagaacaagctcaccacgagcaaggaggtggcagcctgatgaacgagaacaagcctgtgaagcatggcgcattatggaccgtgctgtttgccgtcgtctccctgttctggattttcccgatcgtcctggttctgatcaactccttcaagcagaaggcgtacatctccaagaacgccttctccctgccggctggcaaagcgtttgtaggacttgagaactatgtgcgcggcatcgagaccacgcagttcttcgcctccttcggctggacgctgcttatcaccgtcggctcggtggtgctgattctggtgtgcacctcgatgtgcgcatggtggatcgtgcgcgtgaacaactgggccgcgaagctgctctacaccctgttcctgttcaacatgatcgtgccgttccagatggtgatgttcaccctctccaagatcgccgacatgctgaagctcaataccccgtggggcctgtgcatcgtgtacctcggtttcggtgccggtctggccgtgttcatcttcactggcgtgatcaagggcatcccgcaggagcttgaggagtccgccatgatcgacggcgcgtcagtgccgcgcatcttcttccagatcgtggtgccgattatgaagccgtcgatcgtctcggtggccatcctcgaagccatgtggatctggaacgactacctgctgccgtacctgacgctcgacctcggcaagtacaagaccgtctcggtcgccgtgcaatacctcaagggcggctacggttccgtggatatgggcgccatgatggcctgcctggtgctggcaatcatccccatcatcgtcttctacttggtatgccagaagtatatagtctctggtgtcatggcgggagccgtcaagggctgacgactcgcgtcgtcagcccatggctggaagcccagtgggcttccagcaggctccaggctgagccgcgacagcggcgaagctaatgatgagcctcgtcgtaggcgagtccgtaattgcagggccgaaggcggagcggtcaagggttgagcccgacaatttggctcccctccctgaggggagccaaaagctgtacaaggagtagttgatgaactggctggcaccggactcgaaattcatgcgcgcgtggagcaatcttgttgacggcgtgtggatcaacattctgatgctggtcacctctattccgctcatcaccatcggtgcagccctgaccgccggtcatgatgcttgccgccgctccatcgagggcgagggcaaaggcgtaacctccaactacttcaagtcattcaaaaccaacttcatcaaagccacactgctgtggctgccgttcttggtggcgctgattgcactggtctggtcatggatcgtcctgcagatcacgccgctgctcatcatcaaattcgcgctgaccatcctctggcttatcggtttcgaatgggtgttcgcgcttcaggcacgcttcgagaacaccgtggccggcaccttgaagaacgccttcatcttcggcatctcccacatcgcgatgaccgtggccctggtcatcgtggatgccgtgttcgtggcactgctggcggccagctggttccacatgcccggtggactgttcctgctggtgatccttggttacggcaccatgctgatgctccatatccccgtcgccgagcgtgtcttcaagccatatctcattgactaggcgggttctcacgaatatgcggcgatcttcgaggtctgagcgctctctgtccacgcaagcgcggtaaagataacaaattaataacagtttggggcggctggcggagcggggtgccgattgagggggtattagtgattggcttggaagggggcttttgacatacggggggtgttcggactgggcggttgcccccgtaagtgcttatatacataaggaatctggcacactgagtctcagtgccgtaatggtatcatcgcaaataatgtttgcgttcacgtagaggcaaacgagacacccgacaagtgggtcgaggcaaaggacaaggagagatgcggtgaagcattggaagaagatggcagcatcgttgattgcaatatcaacgatggtggcagtagttccgacgacgtatgccatggaatcggaagattcccaaccacagacaaccgataccgcgacagtgcagactactaaggctgctgaaccgacgctgctcgccagctgggacttcacgggcaaaaacggcaccacgaacagcgcgattgccgattcgaccggcaagtacaacctgacgctgaaggacggcgccaagatcgaacagtacggtgaccgcagcaacaacgaggcgctctcactgcgcggcgatggccagtacgcccagatcgatgaccagctgttcaaggatgcgggcgactccttcactctggagttcgcgtccaagactcgtcacgacgacagcggcaagttcttctcgttcatcgtcggcaaggacggctcgaacgacgccaacaccaccgatcaggccaacgccaacaagtacctgatgttctacaacagcaagaccgccatcaagggcgttatctccaacaacaactggggtaacgaacagggatccaaggtcaccgtttccggcaacgacaacagctgggccgattacaagattgtcgtggacggcaccaaccttgccgtgttccgcaacaatgccctgatcattttcaaggccaacaccggcatcaagatgagcgatctcggtgcgaccaccgcctacatcggcaagtcgttctactccgtcgatgagtactggaatggtgcaatggatgatatcaaggtctacaggggcgctgacctgaccatgccgaccgccgttgcgatttccggtaccggtgtggtgaacaacaagctcaccctgattgagaaggactccaccaagctcaccgccaccgtcactccggacgacgccgtgagcaagaacgtcacctggtcctcctccgatgagtccgtggccaaggtcgccgcagacggtactgtaaccggcgtcaaggctggtactgccaccatcaccgccaccactgagctgggtggtgtgaaggccgaactgcccgtcaccgttgagccgatgaacgccaagaacgctgccgaagccgacctcaacgccgcgatttccgcgctgaagaccaccaccaccgagaacctgccgctagttgccgaaggcaccaagaatggttctgcgattacgtggaagtcctctgatgaaaagctcattaccggcactgacgccaagtacgaggctccgaagaacggtatggccgatccgtataagggtgccggcgtggtgactcgcccggcttacggcgacggtgattccaagcctgtcacactgaccgccactgcctcctacaacggtggcgaggtcgtgaccaagaccgtggaagtcactgtcaaggagcaaacccgctccgttccggacggcgcttatgcggccgtgaccttcctttccgatgaggccaccaccaacggcaagatcggtgaggcgctgtacgagtccgccaccgacggcaacaacttcttctcgttcagcgagattaacagcggcaacccggttatcgtctccaacaccgataccaagggcctgcgtgacccgtatgtgctcaagtccaaggatggcgacaagttctacatgatcgccaccgacctcaaggtctcctcgcagggctggggccagaaccagcagtatggctctctgaagcttgaagcatgggagtccaccgatatggtgaactggactcgcaccaacgccgaggacggcgacaccggtatcaaggtcaacgccgacaacatgggcatgacttgggcaccggaagctttctgggatgacgcgctgaactcctatgtggtgttctggtcctcgcgtgaatacaccgatgacacccgtgccaccgcagtgaaaagctcgaagaccaacggcgcatacaacatccttgtgatggccaccacccgcgacttcaagacgttcactccggccgagaagtggcaggatacccagtactcccgcattgattccaccgtgttcaagattggcgatatgtactatcgcctgaccaagaacgaggaaagcggcaaggccggcgattacatcaccaacggcaagtccacgttccttgagcgttcccagtgcctgacttgcaccaccgccgccgctgatccgaacgccgatacgaccaagacctggcagctcgttgaccagaacatcctgccgttcgaaggcccggagtccatcaaactcaatgctggcgacccgaaccagaatgaggctggcgatgcgatgatcatcatggccgactccggcggatacaagccgtacatgacctccgagtccgccatcgcggcgtccagctggaccaaccgtctgtcctccaccgacggctggggtaccgagaagcagtgggggccgaatgtcacgggtaaggtgaccccgaccaacatgccgaccccgacccgtcacggcgcgttcgtgaacgtgtccgctgccatcgcggagaacatgcacaagtggaatacctccaccccgaccacgctgcccgctgttgactccgctaccaaggccgagtacaacgccgaaacccgcgaactcaccgccacggtgaccgccgctgacaagggcacgctcgccggctcggtgaaattctctgctggcgactggtccaagaccgtgaagctcgacgccgaaggcaaggccacggtgactctcccggtcaccatctctggcactgttgcggtcgcctacgacggctacaccgatggcttggtaaacccctcctcgaccgaggtggccggcatcgagcagggcaaggtcgatttggctgagctcaacaagcagatcgccgctgccgaagcgctcaaggaatccgattacacggctgattcctgggctgcgctcgccaaggcactgcaggccgccaaggctgcgctcgcttcctccgaccaggctgtggttgacaaggccgccgctgatctgagcgccgccatcgcagcattgcagaaggcggaaacgcccaccaagccggataccggcgatggtgacaacaagggcgataacgcaggcgacaagaccgacaacaagaccgatgacaccaagtctgacggcaagttgccggccaccggtgccgccgtatatggcgtgagcggtgccatggtgctgctcgccgctgccggcactgcgctgtccatctggcgcaagcgccgcgcataactgagtagctgctcactgcaacgcacagaaaatcgcacagtatatgtgtgattttctgtgcgttttaatgtataacagcacatgcgtcatttttttttgcattggcgtggtcatgctaaatgtatgtgctgtagaacctgtgtaccgtaccagtgaacgctaacactaaacttataagtgcttacatttgggcgtgctatagcgcatcgatgttgtccccggaaaacggtgttgttcgtaggggcggattggtgggcaagcgcagtcaaatgtaatgcgaatcagcaagcgagaaagtgctgattcgtacaaggagacgcaaaagtggccgataaaggagtggccaagcgccatagcgataacaatttgataacaatctagcaaggatgcgaggaaggaaactcgatgaggagagttactcgattggcggcctgcttggctgcggtatcaacgctgagcgtgggactggttacgccggtcaccgcgttggctgacgatacgacacctcaggtgcagcaatccgttcagacgagcgatgctcaggctgctgcggctgtagacccgcttgccggcttcgatttcaatagcgacccggacgatggtgcattcgccagtgctcagggtgacgctaaggccaccgtgcaaggcacggtggatctcgtcaacggaaaagatgacgacaacggcaaggccgcccagctcggcagcggtttctggctgaacgtgaccaagtccgatggcagtgcactgctcaacggtcttgatgatgtgacgatcagctatgacagtaaggcggctgcgaccggtggccagtggactgtgtttgccgcgccgaccgccggtgcggtgaacggcagcgcccccacctacgtcggtgtgctcgaccgcaccgacaagacccgcgtggaacgctatctcaacggccgcgcatccgacatcgccaccatcgacaagaacaccggtacgaaggatgcttggaagcatgtcgatctcgtcatctccggcaagaccgcgaagctctatgtcgataagaagttcgtggcgagcaacgtgaacggcgaggatctcaagagcattcttggcggctcaggtggcgtgctgcaaatcggcaaaggcaactggggtaacggtgaatacttcaccggtttgctcgacaatctcacgatttatggctccgcactttccgcggccgatctcggcatcgcatcgcctactgcaatcgagatctccggttccaatgtgaaggacggcaagctgagtctcaaggaaggcaactccgtatccctgtccgcaaccgtcacccctgaaggcgctgagcctacggtgacatgggaatccaataatccggctgtggctactgtggatgccaacggcaaggtcaccggcgtgaaggccggcaccgccaccattacagcggcttccgaagctgacgccgccaagaccgccgagctcaaggtcaccgtcaccgaggtcaaggccgatgacgcctacggctacgtgatggtccacttcatcgaaaacaacaagggctacgccgagaagatctacctcgacatctcgcgcggcgatgacgccacccagtgggatacgctcaacggcggcgagccgattctggtgagtaacgaatccaccaccggcgtgcgcgatccgttcatcgcctacaaccccgagtcgaagacctactacgtgctggccaccgatttgcgtgtgttcggcagcgataatgccggttggggcacgtgggctacaggttacagcaccaagttgcatgtgtggtcgtccaaagatctcattcacttcaacgacatgacggaactggagaccgccaccgccgacaagtacactgccaatccgaacaagagccagacgctcaccgattccgtgaccggcaagaccatctccgagatcggcatggcatgggctcctgaggctacgtgggtgccgaacttctatgatctcaacgacgacggtcagctcaacggttccgataaggacaacccgaagaaccagcagggcggcgcattcgttgtgtattggtctgtctccgccaaatacgatggcgagaacagtcagcccggcaagaaggtgactcacgtgctgtgggccgccaccaaggacttcaccaacgagacttacatgtttggcggcgtcttcgtgcctaacagcaagtacaaccgtggcaacaccatcgacaccacgatgctgcagaacggttcccgcacataccgcaccaccggctccggcgtgatcttcatggaatacaccgatcgtgccgattggtggcgtgccaacgatcagggtcagtacgcgaccgacccggccaagggctgggtgttgcgccagaccaacatcggacacacgctcggcagcgcgcaggaaggtgccaacggtttcaaggtcaacggtgaaaacaagtggtacatgttcgttgacaactatggatctgtcgcctccggtgcccgctacggctacaacctactcgaagccgacaacctcgattccgagaatccgtggagcgtcctgaaggccgatgactacttcctcaccgccaacaccaagcacggtgacattgtttcgctcaccaaggcccagtacgacgcgattcgcgcggctgatgccaaggcttccgacaacgccgacctgaaggccgaggatgtgacggtggataagggttctgccgatacggacatcactgccaagctgccgaagacgcagcaggtcactcttgccaacggttacggcactgccaagcgcgacgtgacgtgggacgtttctaacgtcgacgcctccaagcccggcgagtacgccgtcaccggcacggtcgacaccatcggcgcgaacaagaaccactggaagtggacgaacgccgccggcgagtcgaagaccgacgaggacgacctcatcaacaccggtgcgaacgcgaacaacaactggaagcagaccggtggttttgtcgacaacgaaaccgccaacaagaaccgcacgctatacagctccaccgccatcactgtgaccgccaaggtgaccgtgaccggcgaaaccgagccgaccgacccggatttgctcgccgacttcactttcgagaacgccggcgagaccttcgacggcggcaatgcgacgggtgccactcagggcaccgccacgctcgccgacggcaaggatggcaaggccgcgaagctcagcaagaacttctggctcaacgtcaccgccaagaacggcgacgctctgctcaagggcaagaacgacgtgaccatcagctacgatgtcaagcccgacgcctccggcaacaccggctggaccttcttcgccgcctccaacgccaccaagcaagagtacggccaggagcactacgtcggcgtgctcgacaagaccaccggtattaccgtcgaacgctacaacaacaacgatggcaagcgcgattcctccggcaacgtctcctataccaagacgaacgccgactggaagcacgtcgatatcgtgatttccggcgcaaccgctaagctgtacatcgactccaagctggtagccgtgaacaacaacggccagaagctcaccgacatcctcggtgctgatggcggcgtgctgcagatcggcaaggccaactggagcaacggcgagtacttctccggtctgctcgacaacctcaagatctggggcaaggccctgagcgacgacgagcttggcgtggaaagcgcgaagaccgactacgccgccgcgctcgccatcccggcgcaaatcaccggcgacctgccgagcactgtgctgggcaagacggttacttggtccgcgaccggcgacggtgcgaagctcgtagccgcagacggcaaggtcacgcagccgaagtccggcgagaaggccgtaaaggtcaagctcaccgccaccatcgacggcgtggataaagctatcaccgccgaatccgaaatcctcaacaacggcggcgaaatcgcttcctacgtcaaggatgtcgatcgctccgaccagaacggtgccaagtacgacccgctcgcctacaacgacgatcgtcgcgccgactcgctgtacgtggccgccaaggccgccgatggcggcaaatgggagcccctgaaccgttcgcagtcgattctgtcggtcaagtgggacggctcgcagtctgccaagctgaatgcgcagatgggctcacctgctttcttccgtgcggaggacggtacccttggtgtggtttcctcgcagaacaacgccaccggtgcgatttacgtgtgggatggcaagggcgacggtgccacgttcaccaacgagcgcgccatcaccgtgaccgacagctccatggtcaccaacccgcgcatcgtctatgatgccgcctccaagggctacaaggtcttctggaccgatggcctgagcggcgaaggccgtatggccacgctctccgacctgactgccaaggcaacggtcggcgagacgctcaaggccgacgcggttgcgatgggtgtgggcgacgtgaccgaaggtctgcccgcatgggccggcgaaggccagacccgcgcattcgctgtgagctcctctgaattcgatgcgttctacaagaactatgtcgatctgcagaacaccggcgttaaagctctgggcggcgcaaccgtggagaacggtgcttccgccgaggacgtcaccgcagcggtttccggaacgcaggccacaatgacctacaacgacggctccacgaagaccttcaacgtcgactggaacgccgatgatctggccgccgtggacacctcaaaggccggcacgtatgaggtcaagggcactgttcagcagaccaccgaggccatgtacaacgacgctcgcgccgatccggacatcttctacaacgaagacgatggctactactacctcaccggttccacctatgaggtaaagtccactgattcgaccaacaaccagaaggacagctaccgttccatcggcctcaagcgcgccaagaccatcaacggtctgaaggatgctgaggaacacatcatcatcaagccggagaacggcactccgggccacgaagaccagtaccccaactcgttctacggttggagcgcgttcatttgggcccaggagttccacaagattaacggcaagtggtggattgtggccggcttccacaggggtgcctcgtccacgaacggtggctggtgcaacaacaccatcctcatcccgtacaccggcgacgagcggtccatcaaggatggcggattcctcgaggccgaaaactggggcgagccgaccgtgctggaaggcgccgcattcgacgtgacgtacttcgagcgcgaggagaacggcaaggcccagggctactggctcttcccgaagagcgcaggactgtaccttgccaaggcaaagatgggcgatggcgtcactccgctggtggatggcagccttgagcacatctatcaggtcagccagcagttcgagtacggcaagtatgcgcctacccccggagacaactctgaaggttctgatcaggcaatcgtagaggcaccgttcatgttcgaacatggcgactacgtctacattgcctatgcgggtgccacggtggataagtattacaacaccaacgtgatgcgtgccgccaagaatgccgacctgcaggatctgtcgagctggaccacggccgacttcccgtcgttcgacaccaacgacacctacaccggtgcctacggtgcggatgaggcctcgtacgagcgcaagcaggccggccccggccacatctcgcttgcacatgatgaggccggcaacatcgtcatggcctaccacgcacgcccctacccggaaattcactccggttccgcagcgggtggcctgttcgatcaggaccgcaatacgtgggccaaggccgtgaacgtgcgcgccaacggcatgctcgacatgtcgctgaccaaggatcaggaggttgctccggccaaccgcacggtgaccattacggtgaccgtcggcgagcccgatacgccggttgagccgtccatcaccggcatccgcgtcaagagcgagccgacaaagaccaagtacacggtgggcgagcagttctccgccgatggtcttgtgatcgaggcgacgatgtcggacggcacggtgaagacgctcgatgccgccgactacacggtcggcgacgtggacatgtccgctgtgggcaccaagaccgtcaccgtcacgctcaaggccaacgatcagctcaccacgtcgttcgtggtgaccgtgagtgccaagaccgagcccggtaagcccggttcgggcgacggttccggcgatggtgcaggcagcgataacggtaacgctggtacgggagcagactccggtctgccgtcctctggtgccgccgtgctagccctcggcacagccatggtcgctctcaccgcagctggtgccggtctggaagcctggcgcaagcgcaaggactgagcaggcctagtctgcatagctcccctcagtccgcctcagatggactgagaggagcccaacaaacgtggtttcccaataaacacacttcacaacttaacaaccaactcagccaccccaccattcaatgaggagaaatatatgggcaagtggaagaaaacggtagcggcggtagcggcgctaccggtcatgattgcgggactggccttaggtccagtcaccgcgatggcggcagacaacgacggaggtctgacggacgctaatctcgtcgcatcctacgattttgaggatgccaacgataaaggaaaggacatctccggcaacaataacgacctgaccgtcaagggcgagaatgtcgaatacggcgtacccggagaccatcagtcaggcggcaacgccatccagttgcgaggcaacgatggtcaatacctcgaactgccgaacggtctgctcaatggcaccgactccttcaccgtgcagttcgactcgaagtcccgcatggctgcgaacgacaacttcttctcgttcaccatcggctccgacaaccagaagtacttcttctcccgtctgcgcccaaccagcgtgtacactgccatcaccaaggcctccaacggtaacgagcagggcgtgaccgctacgcagtccgcgaacgtgtggcacacgtaccgcatttccgtgagcccgaccttcatcgccacgttcatcgacggcaaccttgccgccatcaacaagaacgtgaccacgaagctctccgagctcggcaccgacctgccgatgaacttcggcaagtccacatgggccggcgacaagtactacaacggcggtcttgataacatcaagatttggaaggctgcctacgcctccgacggcatggtgtgggatggcgtgaccctgcccggctccaccgaaggcagcgtgactctgcctgccaaagatgcgctcggcaacacgatcacatggtcttcgtccaacaccgcagtgctcggcaacgacggcacactcgtcaaagccccggcccaagacaccgatgtgacgttcaccgccaagtccacggtcaacggcatcgaatacacgaagacattcacggtgaacgtggctgcggccatcaccaccgccgacgcagccgccgaacgactgctggttgactaccagctcactgccggcgcaacgctgccgactgcaattgctgcggcccctgatgcgaaggtgacgtggaagtcctccgacacgagcctcgtcaaagacgatggcacagtcgttggcacaaacggcgacgctgagaagaccgtcgaccttactgcgacggttacgctcggcaccaccagcaccacaaagaagttcaccggcgtgcgcgttatgccgaagagcgccgaaaccatcgcctcctacacgcgcgcaggttccatcagcggcggtgctcgtgttggccagtcactgcacatggcgctgagccaggacggcaagtcttacgaggcgttgaaccagaactacggtgtggtgttcgccgaggcgaactacatcctcgatgaagccaacaaggctctcaataccaccggcgcagaaatcggccgcggtatcgctgacccgtacctgttccgcatgaaggatggcaagtacgccttcgtctccacgctgaccaaatacaataccacgcgcggccaagacagctcgtcaaccgcatatccggccgatcccggtcagattctgatgctcacttctgacgatctgatccagtggaacgatgctccgaacgactatgaggtaactggccgcgtcaaggtgaccgacgacaccacgcagttcgacgccggttcgctcaccgctggatacgatgcctccgccgacaactaccgtgtcggttggaccgtcaacggtgtggccaagtacgtcaccacaacggacttcaagacgttctccgaggtcaagaccggtgctgcattctctaagacgaccgctgacctgagtggcatcgacaacgctgtgacatccaacacgattgcggttgatgcctcgctggcggccaaggtagccgaaaagctcggccgcgtgaccaacaccggtgtggaaggcccgaaggatatcaccgttgagaagggtgccgatgcatccgcgatcaaggagcggattaccggtggacagacgcttgaaaatggcaacctttccaagggtgccacggcaacggccacttactctgacggcagtacctatgacttccgcgtgaactgggatgcagatgacctcgcagccatcgatacgtctaaggccggcacttacacggtgaatggcaccattgcccagcagaacttctctgacggcacgatgatgtatcgccgcgctgacccgaacgtggtctactggcagggcaagtactacttcatcgccaccaacgaaggcgctgatcgcaacatctacatccgcgtcgccgacacgatggaaggtcttaaggacgctggcaactccgtaagcgacggcgacggtggccatattgtgaacggacaggacatcttcctgtggggcaacaaggacgacaccgggcacgagggctaccactgggcgcccgagctgcacgccatcaccgattccaacggcaagacgcacctgtactgcttcttcgcccaatacccgaccggcaaggacggtgatccgtcgttgtccggtgcgccgaactgggcaggcccctccgcctacgtgtacgagctcaaggatgggggagacccgaccaagaccgctgattggaccgagcaccgtgtactcaactccaccggcgacgcgctcaacaccaaggctctgaccatcgacatgacctacttcgaggttgatggcaagtcctatgtggcttggagccagggcgatgacacctacaagggcgctcgtgcatccctgtacatcgccgaaactagcaaggacaagccgtggcagattacctccgacgccacccgcatcgtccagcctgtgtacggctgggagctgtccggcgtgagcgaaggccctaacgtgctcgtcaaggacggcatgatctacatggtgttctctgcgcaggaagtctccgaccagtacgccaccggtatgatgaccgccaaggttggttccgacctgaccaaggcatcaagctggacgaagtccaactatccgtggatgcacaacggagtattccctggccagaacggcttgggccacaactcctacttcgcggatccgtatggcgacatctacaacgtgtaccacttcggcaacagcggtgcccgtaacgcctccatcgtgccgattcacttccgcaccgacggctcgccgattctcgatatgaaggtgtcggaggaactcgaccagtcgaagaagaacgtgacgctgaaggttgtggtgaccgaggatcaggtgtcttctgatgccacgctcaagtcgctgaacgttgtcggttccgatatcgacctcgacacggctgcctccactgagggtgccgcgcttgaagtcgacgatccgagcaaggtgaccgatgccgatgtgaaggccgaggtgaacgatgccaacgccaacgccaccgtggccgtggcgaacaacgtggtgacggtgaccgtgaccgcgcaggatggtacgaccgtcaaggtctacagggtcgtgctcgccaagaaggccgtcacgcctgaccctgaaggcccgaccgatcctgattccggcaaggatgacggtgacaagaacaccggcaaggatcctgacaagggcgacaagcccggcgctgacctgtccgagactggtgcagctgtgctcggccttggtggtgccgtggtggcgctcgccgtcgccggcatctccctcactatctggcgcaagcgctgcgcctgagcggattcaaatgctccctctcagtcggcttctggcggacggagaggaagcacctagtatcaccataacttgaacaatttcaaaactgcgcctcataactgaaggcgcaaccacaaccaaccctatcaatgaggagaaacatgagaaagctgatacgaaaggcaaccggacttacggtcggcgtggcaacactgctcgctggtctggtgctgccgatgacggccagtgccgagagcgcatcgccaatcgacgccagtccgatcatccactattcattcgataacgcactgacgtccaagaccatcgccaacgagggcagcgcggccaacagcgatgccaccctatccggcgacgccacggtggccaatggccagatcaacctgaccggctcgcaaaccattagcgtgccgaccacggccatcgccggtaagaaggacgttaccgtctccatctggctcaagaacaattacggcaacggcaataccgccgccgcgtacatcggcgcggccaagaccggcaattatccggccaacggctactggctgctcaacccggccaacccgagtggctacgcgaaatccgtaatgaccaatgccactgcggccgacccgaataacagcccgtggggcaccgaagtcggccctggatcgacgaacgccgccaccatcggcaccaaggccaccagcgatttggctctgtacaccaccgtcatcagcggcaccaacagcaccatgagcttctacctcaacggcaagcaggttggagacgccacctacaccattccggccggtggcctgaccaattacggcgacctcgtcgcctacattggcaagtcctcctacgctgacccgaactccaagctcgacgtggacgattacgccgtatacgacactgccatcagcgccgcagacgtgaccaagctgtatgacgctcaggtgctcgacaaggccgaggccgctgtcaaggccgctgtgcccgcatccgctaccgaggacttcgcgctgccgaccagcgccgctggcgtgagcattgcgtggaagtcgggcaacgcagccatcgccgttgacaacgctaccggcaaggccacagtcactcgtccggccgcaaccgcagctgatgccgaggtaaccctcaccgccacgttcggcaacaacgccaaaaccgccgcctacacggtcctcgtgccgaagcagttctccgatgccgagcaagccaaggccgaccttgacgccgtcaccatcgaggactccgacgacatccgtagcaacttctccgtgcccaccaagggcaacaatggttcgaccatctcgtgggaagtgaccggtgacaaggatatcgccacactaggcgaaggcgtgaacgacaaatctcgaacggtcactgttaagcgccctgccgccggaagcgatgccgccactgtgacgctcaaagccactgccaagtacggtaccgccaccgaaacgaagaccttcaccgtcaccattcagccgatgcctgccgccgaagagaaggacgaggcctacgtgtgggcgttcttcaccggcgagggcgtgggcggcgagaaaatcagcctcgcggcttccaagggcaacgatgcgctcgactggaacacgctgaacaatggcactccgctgttcacttccgagtttggcgagaagggtttgcgcgatccgttcatcatgaagtccaaggatggtgacaagttctacatgcttgctaccgatctgaagattgacggtcgtgcccccctcaacgggctgaatggctttgctggtgcacaggctaacggttccaagtacattgagatttggaagtccgacgatctggtcaactggtccaggcaaagccacgtcaaggtgagctctgattacgcaggcaacacttgggcgcctgaggcctactacgacgaggaaatcggcaagtacgtggtctattgggcctcgaacctgtacgacaacaccgacgagaacagccgcaagcagctgacctacaaccgcatggtgtacgtcaccaccgatgacttcgtcaacttctccgacccggtagtgtggattgacgttgatcgccgaggcggtgcaggcagtggatccatcgatgtgaccgtgcaaaaggtaggggatacctactaccgcatctacaaagatgaaaacacgatgtctttgcgtcaggagaagtccacagatttgactgccgcaattggtggcgccggcgtgaagaactacgccgatgcgcttaaggatagtgcatggagcgaagttgccacgaacatcggtaaaggccaggctaacggttacggtaaaaccttcacttccggcgaaggtccatcgctattcaaggccaacgatggcgatgtgaacggctaccagtactacctgttcgccgaccagccgagctatcatcaaggtccaaaccactatgtgccgatggcgactgaggatatcgccagcggtcagtggaccgttatcggcaataagatgcctgaggcgaacttcccgaccaactccgatggcggcaagccgcgccacggaaccgtgctgcccgtgacccgcgcccagtaccagaaggtgctggaggcatacgctccggctgtggctgtgaagtccgttgacgcgctgtctgccgagacgacggttggtgtggctccgacgctgccggagaccgcgcatctgactcatgcggacggttccgtttctgacgttgcagttgagtgggatgccattgacgcatcttcctacgccaagaccggcaccttcaccgtcaagggcatcgcccaagacgattcccgtatgccggtcgaggctaccgtcattgtgaacggcatcgacctctccaaggcgaccgtcaccgtcgaacccaacgagttcaccgcagacggcgctgccaaggagccggccgtgaccgttgtactcgatggcgcgacgctcaaggaaggcgccgactacacggtggcctatacgaacaacgtcgaacccggcaccgccacggtgaccgtgaccggcgttggcaagtactccggtactgtctcggcaacgttcaccatcaaggccgccgagcccggctccacgctggacaagtccaagttgcaggcgcttgtcgataaggtgaagggctataacaaggctgattaccagtctggttgggatgccttcgccgccgcgctcgccaatgcgcagcaggtgttgcagaactccaccgaccagcaggaagtggacaaggcgctgtcgcagctccagtccgccgccgacaagctggtcaagaaggccggcgactccggcaagaccgacggcaaggacgacggtgcccaaaagcccgccaccaagccggacagcgctctgtccaacaccggcgcctcggtgttcggtgcgggtatcaccgcggtcacactgctcgccgccgccggcgccgcctacatcctccgcaagcgccaggcctgagctgcttgcagcgtagaccaagccccctctgacgggccgagccgtacagcaagcagcctactggattgttcgcttcatggcgcggtcccatcagagggggcgtattgcacgttcgtccgacgacgctgtcggacgcataggctctatggccccatagctccaatagccattaccgaacttcaccactcaatatctagatctgttgcgcggcaagcagtatcaccgcgcgcaagaaggagaagcaatgacaaccaaaccatcgataggcaagcgcctgctcggtgtgatgctggcagtgccgatggcgcttgccggcatgggaatcggtgcgaccacggcggtcgcggccgataccgttccgaccgataatctcatcgccgcctacgacttcaccacgaagccaagtgacggcaagaccgtggccaacagtgcgccgaacgctacgcttggcgcggccgaagtacagaactccgccgactcgctttgggccgatgatgccctcaccctttccggcggtgccaagaccggcaccggcgactgggtcaagttgccctcgaatctgctgtccggcaaggacgccgccacggtgcagttggaggtcaaagcggattccagcatgctcaatgctttccatttcctgtggaacatcggtaacgacagctccgatacggagtatttcttcgccacgctcaactgcggcagttcgcgtaacccgctcgtcggcctgaaatcgggcggtacggagacgctcgtgcagtccagctcctgcgtggccaaggccgaccaatggttgtcggtgaccgccaccattgatggcaccgccgcgaaactgtacatcgacggcacgcaggtggcatccggcaccgtgccggccaaactgtccagcgtcaaggaccagtcgctcaacaccatcggccgttcgccgtggcccgacaacctgttcaagggcgcggtctcgaacttccgcgtatacgatgccgcgctcaccgccgatcaggtcgccgcgatcagcactgccgatgcctcaattcatgccagtgaactcaccggttccgtgctgaacggcatcatcatccccacgacggtcgacgatccgttcatttcgctgcccactgcgaacggcgtgacgtgggcgtcctccgatagcagcgtcatcgcgactgacggcacagtcaaccagcccgccaagggcgaggcagccaagactgtcacgctgaccgccgccgtcacagtccgtggccagaccgctacgaaggaattcacggtcacggtcaacccgaccacgaaaactgccgctgaacagctcaaggaagccgcggccggctacgtgatcccgtccgtcgtgcgttccggagacgccctcccggcggctgtgaatggcactaccgccacggttacgtccactaaggacgtagccgtcgaggatggcaagatcaccatcgatggcgacgaggccacgaccggtaccatcaccgtcgagttctccaagaacggtctcgccggcatcgagcccattaccaaggccttcaccgtaaaggtgctgcccgccgcgaagtccgcgaccatcgccgcctacgatcgcaacgccaccggcgagaatgaggccaacaacggcgacgtcgcctacagcatgcacctcgcgttgcagaacgctgacggttcgtacaccccgtacaacgagaactatggtatcttcttcgcacgttcgccgaaggcgcagaagctcaacgagaaccttgacggcaatgactatcgcagtctcaaggatccgagcctgttccgcatggccgacggcacctatggtgtgatttccgtgcgcactaaccgtggcaccgccaccggtgattccaccgcgaagtccagcgtgctcatcgccacttccgaagacctgctcacctatagcgaacaggagaactccggttccatcatcgatcttggcgagaccaacggcgtcaacgctccgtacgccgtgtacgacaccgccgccaagcagtatgtcgtcggctgggccgatgacaacggcgtggccaagtacaccacgttcgattcgctcaagggctccacatccaagcacggtagcgtactgtacggttccgtcgccaagtccggcgtactcgccgccgacggtgtgcagggcatcgcgaacttccgctccggtgccaccatcgcggtggacgaggccacggtgaaggcgctcaacacccgttacggccgctctgagaacaccggcacgagcaatctcactgacatcaccgtcaagaagggcacctcaatcgatgaggtgaccgcgcaactgccgaagaacgtggacctcacttactccgacggttctaccggctccctgccgatttcctcatggaacactgagggcatagatctgacgaaggtgggtgattacactgtcaccggcaccgtcaagcagaccgaataccagattccgttcgccgaggaccgcgccgatccatcggtgtataagtggcagtggacgcatgaggtcgacggtaaggaagccaccgaaaccaagttcctgatgatcgcttccaacgacatccaaggtgacgtcacttggcagcatggttcgccccacatgccgttccgcatggccgacacgatttccggtctcgccgacgagccgggcaacccgaatgccctgattcagtcgaacggctacaacaacaaggaggtgtcgctgctcaaggctggcgacaaggactccgagggtaatgccatcatgcacagcttctgggctccagaaattcatgagatcgatggtaggctcacgattctgttcatggccggatacggcaacacatggtccaacggcaagtcggtgtacatgcagctcaagcaggatgtcgacggtcacgacctcgatccgaccgaccccgataactggactgtgccgacaccgatctaccgcaatgacgcctcgctgctcaacggtaacaagcagctcgcggccaccgcgtccggcggagtgggcatgtcgctcgacatgacctatttccaggatgccgacggcaggtcctactacgcctggcagcagctcggcgccacctacattgccaagatggacccgaaggacccggcccatgtgaccagctccccggtgcgcatcgtcaccccggagtacgcgtggaacgccgccatagccgaaggtccgaacgtgaccctgcgcgacggcaagctgtacctcatgttctccggttccggcgtaggcaagacctacaccaccggtttggccgtggctgatgccgccggctccgacctgaccgacccggccagctggacggcgctcaactacccgattcagaagtccggtccgttcaacggcgagatgcagcttggcaccggtcacggcatgtggagcgaggacgaggacggcaaccaggtctacgtgttccacgcctatgctacgaagaatctcggatccgtgaatgctaccggccgcgacatgttcgtgcgccgtgtgcactgggccgccgacggtatgccggtgtttgacatgagctcttccgaggagctggcctccaagaccgtttccgtgacagtgaaggtggctgacgacacggttacggtcgacaagaccgacctgtccaaggcgctcgcgtccgccaagcagctgcgcgagtccgactacaccgccgcctcgtggaaggcgttcgccgcagcgttggcctccgccgagaaggtttatgccgacgagaacgcttcgcagaaggacgtcgacgacgcaaccgccgcgttgaacaaggcgcaggccgcgttggtgaaggtcgacggttccgattcgggcgatggctcgagcgattcgactaagccgggcgacggctcgagcattgacgctggtgctactggtgataagacgggcaacaagctcggtctgtctaagaccggtgccgccgtactcggcctcagcggcgtggccgtggcgctcgctgccgccggcatcgccctgaccctccagcgcaagcgccaggcctgagcggatccaaatgctccctctcagtcggcttctggcggacggagagggagcacctagtatcaccataacttcaatcttcaatccataactgaacacaaaaccaaaacccacaatcagaggagacatatgggtaagtggaagaaagcggtggcagctcttgcagctgtcccgatgctgatggcgctggcgccagcagcaaatgcggttgaatcggataccaccgattcatcggccgcacagcgggcgctggcagcagccctgaaatcaaatgccaaggcatcggcagacagtgatttgcttgccagccttgacttcaacaacgtcacggcaagtgccactggtaccttcaccgatgaggcaaccggcaccaaggcaaccatcaacggtgccgccgcagtaactgccagtaaagacggcactaccgcagctcagctcggttctggcttctggctgaatgtgactaagtcggatgattcggctgtgctcaagggcctggatgcggtcacgatttcgtacgattccaagtccgccagcaccaatcagggctggtcggtatttgcggcaccgaatacgaatgcgcagacctatcagcaagagcattacctcggcgtgatggatcgcaccacttcggtgaacgttgagcgttacaacaacgctggtaagcgcgacaccaccggcaatgtgagcaaggatggtctcgccagccagtggcgtcacgtcgatttggtcatcgacgaggccgcttccacgctgtacattgacggtgagcaggccgcaaccgtagccccagctgatggcgcgagcttcgctcagctcaccgatattctcggcgcagacggcggcgtgctgcagatcggcaaggccaactgggtgaatggcgaatactataccggcgcacttgacaacctcaagatttacggctctgcgcatactgctgaccaaatcaaggaagcctacgattccacgaagtccgatgccgccaaggccgacgctaatgcgctgaccattaacaacggcagcactgatgtgtattccaacatcacacttccggccaagggctcggttaacggttccgcgattacgtggaaatccagcaacgcaaaggtcattaccgatgcggcagatggtgacatcgcagctggtgtcgttgctcgtcagaaaaccgacaccaaggtgacgctcactgccaccattaccgatgctgacggcaacacggaaaccaaggaattcgagctgaccgtcaaggccgccgtcgaacagccgaagaccacggactatctgtttgcgcacttcaccggcaccgaaggtagcgctaccgacgagcagatgtacttcgccaccagcaaggatggcctgagctggcatgacacccgcgagtccggcgatccggtactcagctggaacaacagccagaccggcaactctcgtggtaaggacaacggcgtgcgcgacccgtatctggtccgctctccggaaggcgacaccgtctacctcatcgctaccgagctgagcatccataaccgtggcggttggggcgcggccaccgctaccaccaatggcagcaccaacctaatcgtgtgggagtcgcatgacttcgtcaactggagcgaaccgcgcgccgttgacgttgcctctcagattccgggagccggcatggcttgggctccggaagcctactgggatgatgtgaacaagcagtacatggtgtactgggccactgcttccgacgcggacaacaagtccggcgatcgcaccaatatgtactactccaccacgcgtgatttcgtgaacttcacgacgcctgtcaagtggatcgaccgagtcaagtccgttatcgataccacgatgattaaggccgatgacggctattactatcgtgtgtccggtgacacgtacctcggtgttgagcgtagcaaggatccgtatgccacaacgctcaccactggtgacacaattgcgaatggttactacaacactgacagtgatccgaaccagtggacgcttgtcggtacattcggtgacctgactggtaccggtctgaccggtgcgcagctggaaggcccggagctgttcttctacaatgaagatgacgtgcagaccagtgatgcgggcaagaagatgctctacggtctgatgtgggaccagtactcagccggtaagggttacaccccataccgttctgccgatttaggcagcactgataaggctgattggggctttgcctctgatgtgaacttcggttcgctcaagaagcgtcacggcaccatcctgcctgtcactgaaaccgagtacaacgcaatcctgaaggcattcgataagaacaaggacaccgagccagtcacacccgatgaagacggctccggtccgattgccgagtatgacttcgaagacagcaagggtaccgacaccactgagaacagcaacgacttgaccttcaacggcaacgccaaggtctccgaggatgccgaaaagggcaaggtgcttaagctcgacggctctgacggcacctacgccgagttcccgaagggcctgttcgatggccgtaacaagctgactgtgcagatggatgtcaagtcggagatcaataaaaaccagttcacgttcgctttcggccagaactccaccaagtactacttcctgaagtacaacaactccggcgagctcgccagccgcatcaccaccaactcgtatggtgcggaggacgcggctaacgctacgttgtctggcaacggcgcatggcatcgtgtcacggtcacgttggacgacaacgtgatgaccgtgtactctgacggtgcgcaggtggctcagaacaaggcgaccaagaacaaggtcaccgatttgggtaacgatctgctggcctacttgggcaagtccttctacaacgacccatacttcaagggttcgttcgacaatgtgaacgtgtggaaccgcgcgctcactgctcaggaggtcgagaagaccagtccgattgctctgcagggtatttctgtgggcactgtgccgtctgacccgaactcgctgcgtggcactgacgaccactctcaggtgcgttccaccctcgactggtccgcgaagaccgtcaccaccgtgctcaaccgccgtggcgacgcggccaaggtgcccgtcaaggtgaccgtcaaccgtggcgacgactccatcaagctcacccttgatggtcaggcgttcaccaatggtggtacggccgacctgactaaggaccgtactttggttgtcgatttgggtgacggtaatacggaaacctggacgctgaagaaggtcaccgtgggcaacaacccggtgctgcccggccagtacgccgacccggacatcgactacttcgacggcaagttctggatttacccgaccaccgacggcttctccggctggagcggcaattacttccatgcgttcagctccaccgacttggtgaactggaccgacgagggcgtgatcctcgatgtcaacaaggaccaccagccgaccaccgatggcgatgagaacaccgccatctccccgtggtccgtgggctccgcgtgggcaccgaccatcgagaagaagaacggcaagtactacttctactactgcgcgaagttgccgaacggtacatccgccatcggcgtcgccgtggccgacaacccggccggcccgtacaaggccgccgaccaaccgctggtcactcgcacgatggaaggcgtcaccgttggacaggccatcgacccgtccatcttcaccgacccgaacaccggcaagtcgtacatcctgtacggcaacggttcgcccgccatcgccgaactcaacgacgacatggtgagcatcaaggccggtacggtgaagaagctcaacggtctgaacggcttccgcgagtccgtggtcgtcgcctaccgcgacggcaagtaccactggacctggtcgtgcgacgacgccaactccccgaactaccatgtgaggtacggcgtctccgattccatcgacggcaccatcacctacaagggtgtgctgctgcagaaggattcctccaagaacctgcaaggtaccgcgcaccagtccgacgtgcatgtgaccgacgcggacggcaacgaccgttggctcatggcctaccatcgccactacacgccgctcggcgtgttcacctccggcctcggctaccaccgtgaaaccgccatcgacgagatcaccttcgacgcggacggcctgatgcagaccattcacccgaccgacgaaggcgtgtccattgagatggccgatacgacggcgcttgatggcgcgattgaagcggccgacaagctcggcaccgatggctctgcttacaccgaggccagctggaaggcattcgaggatgcgctcgccgcagccaagacggccaagcagaccttccttgactccggcctgtctcaggctgatgtcgatgccgccgccaaggccctgaccgacgcgcagaatgcgttggaggagagccagcccgagccggagcacccggccgcaggcacgatcctctccatcgccgtgaccgcgcagcccgccaaggccgagtacaaggttggtgaagcgctcgacgttgccggtctggtcgtcaccgcgaccgtggccgatggcaacggcggctccaccacccgtgagctcgccgccgatgagtacgagctgctcggcttcgactcctcgaaggcctccgacaaggtgaccgtgaccgtgcagtctgtggccgattcgaccaagaccgccacgttcaccgtgaaggtcgttgccgacgagacgccgactccggatcccgatctggccactgaggaagagctcaagcagctcgaagacgccattgccaaggccgaagccgagaagctgaaccaggacgattacaccgccgattcgtggaaggcctacgccaatgcgctggcccaagcgaagaaggtgctcgccaaggagaacgccacctccaccgaggtccaggatgcgattcgtcacctgaccgaggcccgcaaggccctcgtgaaggtctccgctgatggcaagaagccgggtgccgtcatctccgacactggtgtcgccgtcttcggcgtggctggtgccgtggtggtcctcgccgccgccggtattgccctgaccatctggcgcaagcgccgtatctgacccctcatttgcaaaaaactctcactgagcactcctcagtgagagttttttgcaattgggccttagggctcatacctatctggcgttgggggcgcttgttacggctatgcagtgcgataggtttggttactgctctgcggtttgtcgggcaagcctagaacaagttgaccaggtacgaccaatggttgcacataagtgcgcattgcatatgcagtgctatccagcccaatgaagtttgcgatttgtcggcgggctctcggtgttgcacagaattgcagaattgcggcattacgctcttcgggccggattctgcgccgggaattaggcctctgaccgtttgcctgatagtccagtcggttgaacgcttcgtgactcataacggatggcaacgtagttcgggcgagaggcgaatacaacgtggctctgaactctccacgagtgttttcgaataatggagcggccattcccgtttctgaagcaagtctgcgtacggtggggataccagaataacgattcttcgtcactcgtagaacctccagcgcatttgcgataactggattgcgtgtatctggttgaatagtgccaagctgatcgatggtgagccttccatataggctaccgggattgatgatggtcatacgatcgtcgagaatctgcagctgtatcggcataccctgtgtgtggatgctgtagtcacggtgtatgagtgcatttaatatcaattcgcggacggcctcaattggatattcagcggcatccattctttcgccgttttcgggagagatgatagttgttgtgcgaatattcttgcgtataaaggcgatggctccgcgcagctgttcgtcaagcggcccctcaatgcgagcattgtcgatgaaccgttcttcgtttggccttgtatcgccgatttgcgtgccggggattcgcgttgcgatgatagataactgagggaagaatgcctgtggatacgtggaaaatagcataatcccggctagtgtcggctttccgttccgcaaaacgctggtgagttccagaatgtgtgattcgtccatccgcgcaaaatgtgggcgctcacttttgagcgcgagttcatgccgcagtagggagtcttggttgaggtcatcggcttcggcgcgttccacgatgcgtatttcgtcctcgtatttgcggcgaaacgcttcgtagctgtagatttcgtactctgtcatcttttgacgttgtgtttgagattttcaggttgcctcggcggcgcgattgcgtgttcattgcagcgactcgattggctcgcaagtccgtattgagattcgttgtcggtgtcggtcagtggctgctagtgtgtggtaagcagagcgaactgcatgccacacgtcggtgcataagcgaaaatcgcgtgagctgcgcgaagaagaccggcttatgagagggtcgccggtctggcagagaagaatcaatggtatgtccgatatggtttatgcggtatatgctgtccaaacgcacagatgtgatgtgcggaaattgcttcgacggataccccctgcctccctgtctgtatttcagtgagcgctaacggtataatgcataaacacttacacagtgtgctgatgctgcgctgggattctgcgaatctcttgtgtttcgtgggtttttggcttggtgtcacgctccccacagtgatgcgggtgcatattgggttgggcggtggaaggagccgccgctgttgtgttcgatggacgcagcatccagcctgataacaatttgataacaatggggtcaaagtaggagaggctctcaacgtatgagaactatcgataaagggaaaggcgcgtggcgcaaaggtattgcggcggtagctgcaataccgatggtgttcacgctcatgactgcgggaacggctggggctgcagaagtggactccagcattcagccggccacaagtgatactaacaaggtgctcgatctcggtttcgacggcaacctgaccgacaacagtgccgctgcaaacaccgtcaccgaatataagggcaccgccacctatgttgacggcgtggatggcaaggccattacgctgagccaaggcgcgctcagccttggcgcaagccagaagctccagccggaaagcctgtcgctctcgttctggtggaaccccagcaagacgatgaccggcgagcagattctgatgtggggcaagggcaagtacaacgaaaacggttggtacctgagttccaattctgatactaagccgctcgtgctgtcggtcggcgtgggctccggcggctccggctccggccagccgctcgaattcaacctgtcaggcaagcgcgcggatgtcttccctgtgaacacgtggacccatgtgatggtcacgttcgatgccaagaccaagaccgcgaagttctacatcaatggtgaggcgcagactgctgcctctgataacaccgcttctgccggcaccatcgtggccgacgacaccaccaagtacatcggctggaatggtgcccatgcttccggtggccagctcaccggtatgttggatgacgtgaaactgtggaataccgtggccaacaccgccgatgcggagcgtgaagtcaaggtcggtgacaagagttttgacgctaccacgctggctcaggccgcgctcgacaaggtgaatatcgctacttcggcaacctccaacctgaccttcaacactgaagcggccaatggtgcaacgctgacgtacgcttccgataacgaagcggttatctccaatgagggtgtcgtaacccgtccggctgtgggcgaggccgatggcaccgcaaagattaccgtcactgcctcctacggctccaaggccgtttccaaaaccgtgaccgtcaccgtgccagcgcagaccgaaaacggtggtggacacgacgtgcaataccttaagaactacctctccgagcagggcatggagaacgtcaccgtagccgacgaatacctgcagaacgccggtaagaaggaagtcgagtatctgctgagctttgagccggaccgtctgctggtcgagttccgtgcacaggccggtctcgacaccaagggcgcgaagaactacggcggttgggagaacggcccggacgagagccgcaaccctgacggcagcagcaaaccgggacgcttcaccggtcacttcgtgggtcactggatttccgcggcctcgcaggcgcagcgctccacctttgccacggctgatcagaaggcccagctctccgcaaacctcactgctgtagtcaagggcatccgtgaggcgcaggaagcctatgccaagaaggacaccgccaacgctggtttcttccccgcattctccgcgagcgtggtgccgaacggtggcggcggcctgatcgtgccgttctacaacctgcacaaggttgaggccggcatggtgcaggcatacgactactccaccgacgctgaaactcgcgaaaccgccaaggccgccgcggtcgacttcgccaagtgggttgtcaactggaagtccgcacacgcctccaccgacatgctgcgcactgaatacggcggcatgaatgacgccctctatcaggtcgccgaaatcgccgatgcatccgacaagcagaccgtgctcacggccgcgcacctgttcgatgagaccgcgctgttccagaagctcgccaatggccaggatccgctcaacggcttgcacgccaacaccacgattccgaagctcaccggtgccatgcagcgatacgtggcctacaccgaggatgaggacctgtacaacagcctttccgccgacgagcaaggcaagctcaccagcctgtacctgaaggctgcgcagaacttcttcgatatcgttgtgaaggatcacacctatgtgaacggcggcaactcgcagtccgagcacttccacgtggccggtgaactgtggaaggacgccacccagaacggcgaccagaacggcggctaccgcaacttctccaccgtggagacctgcaacgagtacaacatgctcaagctggcccgcatcctgttccaggtgaccaaggattccaagtactccgagtactacgagcacacgttcatcaacgcgatcgtggcctcccagaacccggaaaccggtatgaccacgtacttccagccgatgaaggccggctacccgaaggtattcggcatcaccggcaccgactacgacgccgactggttcggcggcgcgattggcgagtattggtgctgccagggtaccggtatcgagaacttcgccaagctcaacgattctttctacttcaccgacgagaacaatgtttacgtgaatatgttctggtcgtccacctacacggacacacgccacaacctgaccatcacgcagaccgccaatgtgccgaaaaccgaggacgtcacgttcgaagtctccggtaccggttccgcgaacctcaagttgcgcgtgccggactgggccatcaccaatggtgtgaagctcgttgttgacggtactgagcaggctctgactaaggacgagaacggttgggtgacggtcgccatcaaggatggcgccaagattacctacaccttgcccgctaagttgcaggccatcgatgccgccgacaacaaggattgggtcgccttccagtacggcccggtcgtactcgccggtgcgctgaccgataccaactacaagacgaactactcctacggtggtgtcaaggtgcgcgtggccaactacgattccgaggccaacgccaaggctgcggtcatcccgacctctggctcggtcactgactggctcaagggcatcaaggaggacgcgtccgaaggcagcaacctcgtgcgtaccgacgatccgaacaccggcaaccgcgaaaccctgagcttcaagttcgccaatgttgacggtgacgccgccgacctcacgctccaaccctactactccacgtacaagaccacgtacgcgatctactgggatatggccgaggtcgattccgaaacctaccagaacaacatcttcaagaagaagaccgacgctgcaacccagtcgatcatcatcgacgcggttgacgccttcgacaacgagttccagcaggagctcgcccacaacgccgctaagtccgacgactccaacgccggcacctacgaggacaagcagtaccgtgacgccaaggccgacggctggttcagctacgatctcaaggtgaacaccgaggccgatgccaagaactacctgagcgtccagtaccagtccgccgatgcgggccgcacgttcagcatgatcgtggatccgaccccggtcgccgacaactcgaagggcgaggtctccgccaacgcgaagacctacaccgtcacgatcgagaacaagggcttgaaggccttctactgggatgtccagcaactgcccgccgacctgattgccgaggccaaggacggcaaggtgcgcgtgctgttcaagtccaccggcggtctcgtcggcggcgtatacggcgtgcgcatgcagaacgctgcggcgttgtctaccgatgcctcgctgaagtcgctttccttcgacaagggcactcttgacccgaccttcgatggttccaagacccagtacacgctcaccgttccggccggtactgagtccgtcgatgccaccatcggcgtgaaggatgccggtgcctacgtcaaggtcgatggcatcatcatcgatgacaccaaggcccgcaccatcgcgctgaccgacgacgtgaccactgtggaaatcacttcctacgcgcaggatcacaaggccgtgaagcactactcggtgcagatcgtgcgtggcgacgccactgtgcccgccgccagtgatccggtgcttgagtacaccttcgacacggacaccatcgtcaaggacggcactatcgacaacactggtaccgcaggcgacaagctcgacggtaaggtcgtgaacgatggcgcatcggcaagcgaccatgccgacaatggcaaggcgctcaccctgaccggtggtgacaagggctccgcgtctccgtacgtgcagattccggccggcctgattgatgccagccagaaggacatcaccatttccgccgactaccagtgggacggcaacaacacctgcatctacccgtgggcgttgggcaaggacaccaaggattatttggtgaacatcgtctcctgtggttccaatacacgagtcgaggcctcgaagtccggtacccagactcagcttgccggttccactccggccaagaacacgtgggttcacgtggatgtggtggttaagggcggtaagtccattgcctactaccttgacggcgaactgatcaagcaggtctcgaccacgctgaccgccgccgactttgttggcacaaacaacattgccggttacctcggtaagtcgttctataacgacccgtacttcggtggtcagatcgacaacttcaaggtatggaaccgtgccgtcaccgccgccgatctcttcaacccggacaagggtgacgagccgactccgactccgtccagcgatgccacgctgaagtccctcaccgtggccggtcagacagttgaccttgcggctgccgctactgaggacggtgcttcgctgaccgttgatgatccgaccgctgttaaggcttcggatgtggtatttgaggccaacgactccggcgccactgccaaggtgaacgtcaatgacggtgtggtgacggtcatcgtcaccgccgcagacggcaagaccaccgagacctacacggtcaagctggtcaagaagactgtaccggtcgagtccatcgccattttcggcgacggtgtggctgaaggcaagttggctctggaaaccggcaagtccgtgaagctcactgctactgtcactccgacggatgcagatgatgctgcggtctcgtggtcggtcgagggcgatgccgtgaccgttgacaagaccggtctcgtgaaggccgtcaaggctggcaccgcaacagtaaccgcgaccgcaggcggcaagaccgcttccatcaccgtgactgttaccgacccggtcgttcctccggcaccttccgttgattccgtcgccatcacaggtagcgaggtcaaggacggcaagctggagctcaaggttggcggcgaagcgactctcaccgccgacgtgacggtgaccggtgatatcgccaagaccgtgacctggacctcctccgacgagaagatcgcaaccgtggatgcgaacggcaacgtcaaggccgtggctgaaggtaatgcaactattaccgccacgtctaccgaagacgccaccaagtccgcttccgtcgcggtgaccgtcaccaagaagaccaccaccgagccagagcagccggagcagcccgccccggcagagaaggatctgactgacgcgaaccatgtggacgacctcatcaccgccgaatccataaagccgggtgccaagctgacgttgaacgtgggcaaggcattcgcaggcaagacggtgaacgtgtacgccttctccaacggcaaggccgtgctggtcgcctccggtgtgaccgtctccaaggacggcactgtggtggtgactgtgcccgccgacctgaagctgggcgccacgaagttcgctgtccagttcgctgacgattcgctggtctgggatgcggtcaacgtggccaagcccaccgccgaacagcccaaggccgacgaaaccgccaacaccggtgccgccatcctcggcgcagtagccctcatggccctcctagccgccgctggcgctgccctcatcatctggcgcaagcgtcaaatctgaccccaattgcaaaaaactctcactgacgcttagtcagtgagagaaatttgcaacgagtggcctgattttgcaaaaaactctcgctgggcatccctcagtgagagttttttgcaatagggggcttatcgcttcgcctgagtgatctggtaggcggcgaagagaatggcgagccagatcacgccggcgataacggcgacgcggtagctggcggagaagcacatgagcaccaccaccagtgccaagaacgccaacaccacccacggggtcaccttagcgaacggcagcttgaagtgaatcgcgtcgagcgcttccttgccggacttgccggccagctcggaatcctcgggagcgccgcccgcggcgaccaccttacggaacttcatttcggtgagcatgatcatcgtccagttgatgatgccggcaatggtggcaatcgacatcaggtagttgaacgcgaactcaggccacacgaacaccacgaccacggcgatggcggtgatcacggcggacgtcagcacgccggccaccggcacgcccttagcgttgagcttgcccagatacgcgggtgcattgccttgtttggccagcgaatacagcatgcgggagttggcgtacaggccggagttgtagacgctcatcacagcggtcaggcacacgaagttgaggatgccggcggccgcgtggatgcccacggaatcgaagatttgcacgaacgggctgggaacatcgtctccgccgatggtgttccacggtattacggccatgattacgccgagcgcgccgatgtagaacacgaggattcgccaaataatatcattggtggcgcgcggaatcgtggtcttcggatcctcggtttcgccggcggtgatgccgatgagctcggtgccgccgaagctgaacatcaccacgacaagcgccatcaacaggccggtccaggtgccgtctttggtctgctccatgagaccgttcgggaagaagcccccttccaaggtgaaccagttggcaaagctcgctttgatgccggatgcggtgggcagagcgaagatgatgacggccaggccgccgacgatcatggcaatcacggccacaatcttgatgatggcgaaccagaactcgaactctccgaacttggagacgcccagcagattggcggcgcagatgaccactaggaatacggctgccgacacccaggtcggaatcgccgggaaccagtagtttacgaatttgcccaccacggacagctccaccatcgagacgaggatgtagttgaaccagtagttccagccggagatgaagccggcgcgcttggaccagtagcgagtggcatagtagctgaacgcgcccgccttcggatcctcgacggacatctcgctcagcgcgcgcacgatcatgaagatcgcgaggccgccgatcaggtaggccagcagaatcgaggggccggccagcgcgatggattcgctggaaccatagaacaggccggttccgatagcgccgcccagtgcaatcagctggatgtgacggttcttcagtgacttgcgcagcgtggccggcaccggcacatcgtcggtttcgcgcgacttcttaggtgcgtcagtagtactcattgtgctcttctctcgagtctctttgatttttagcatgaccggcgggaggtcgccatgcgcaacgctcgtcattgtaaggcgcggcatgccgtaatgccaaagaatgccgatgccagcccataccggtattcgcgtttgatcgaaacagctaaagtcggcagtggcctatcaaaccatccccaccaattcactgcgagacgggcatgcccatggtgaaaatggtgtgggccactgattccggagatgctgcgaggtcggtggcgagccagtattgcagtaggccgatgctgccggatacggcgaagcgcatgcgcatttgggcctcgaccgggtcgttggcggcgggctgcagctgctcggcgactgtctgccggctgtaaataagtcccagtagctgctgttggaagccgatatctgctttcgggctcatcaatacctgcagatgcttgcgattgtcggcgatgtattggcagatacgttcgatgacgtgctcgatgccggctgaatcaggctgcgcgagcaactggtcgagcgcggcagtaacccaggccatggtctcgtcttcgatatcgtgcagtagatcttcaatgcttgtgtaatgcgcatagaacgtggaacggttcacgtccgcccgctcgcacaatgccttgacggtgatggacccaagcggctggtcctgcagcagctcgacgagcgcgtcttgcatggcgagccgtgtgtatcgggtgcggcggctttccgtcaaatccttggccatggcattctccccaagttccgacaactcacaatccaactgttggttgcagaaccgacacagtgttgttttacttgagtatagcaagggaacgcaggtggcattgcgaatggagcgggccgtggtgggaactgttggaggtgcgtgatggcatatatcgaattcgatcatgtggtcaaggaatacccctccggcagcagcgtgattcgggcgctcgatgaggcgagctttaccgccgatcaaggcgagttaagcgtcatcctcggccagtcaggcgcaggcaagaccacggcgttgaacattctgggcggcatggataccgcgacttcaggccgcgtcattgtgggcgatcgcgacatcaccggattgcgtaagcgcgatttggtgacctaccggcgcaacgacatcggctttgtcttccagttctacaatcttgtgccgaacctgaccgcgctggagaacgtggaacttgcctcacagatttgccccgatcatttcgacccggcggaaaccctgtacaaggtcggactgggggagcgcatggggaatttcccggcacaactgtccggcggcgaacaacagcgtgtatccatcgcccgcgcgattgccaaaaagccgaagctgttgttgtgcgatgagccgaccggtgcgctcgattacgagaccggcaaggaagtgctgcagttgctgcaggatatttgccaaacacaaggcatgaccgtaatgatcatcacgcataattccgcgcttgcaccgatggctcacaaagtgattcgcttccgctccggcaaggtgaccagcgaggaggtcaacgcaacgccgcggcccatcgccgatgtcgaatggtaggtgattggcgatgctcactgcaagacactctgtgaaacgccccgtgaaacaagcgaggcgattcgtgaaacaacctgtgaaacattctgtgaaacggcggaacctcgacgatagcggcggtcgaggagcgggcgtttctgcggtatttgccaaagatacgttgcgttgctggctgcgcagctggaagaggttcgtctcgatcgccgtcatcacgctgcttggcgtggccgtgctgaccggcatctacgccggatgccgcgatgcttttctggcggccggtcgtttttacgatcagcagggactgcatgacctgcaggtgctatccacatacggcctgaccgatgatgatgcaacggcactgcgccgaatcgacggtgtgcaaaccgtgcagcccgaacgttctcagacggtgaccacgttggtggacggcaccaagaaaaccgtgaccatgcaggaaatcggtaccgaagggcttgatcagccgtacatacggcagggcaaactgccgaacaaggccggcgaagtggcggttacgcagcaattcctgaacgatagcggactcaagattggcggcaccattactgtgacgccacaagacacctcttcatccgtcatatcggtagcggccacggagactgacgattccaataatgccgatacggtaggtgtcgccgccaatgcctcggcatccgatgcgaagtccgacgccaatacggacgccgacgccgagcaatccccgcagttccccacgaaactcaccatcaccggcgtcgtactcgacccgcgcgacctcaacaatccagacggctattcgggcatgacctccttccggtccacctcatccgaggactatacgttctttgcacccagcgacggcgtgaccggcaatatatacactgcgatatcggttgccgtcactggtgcgtccgattttgacacgttttccgatgcctacgatgaagccatcaaaaccgtggccgaccgtatcgaacatcagatacaggccacacgccagaaagcccgtcgtcaacagatcgtctccagcgcgcagcgcaaactggatgatgccaaagacgaggccaacgagcagctggacgaagcccagaagcagatcgacgacaactgggccgagctggaagccaacaaaacgacattgcaagatagccgtaccgaattggagaacaacaggacaaccattaccgatggcgaacggcagctcgccgatggacgtgcgcagattgcatcggcccgtcaacagatcgcgcaaggtcgccagcagatagccgaagcgcgcacccagctcgaatcgggcaaagcgcagctcacctcggctcgcaaacagctcgatgcggcgcaaacggaactgactgccaatcgcacgaaaatcgaacagggcattacccaaatcgaccaaggcgtggcacaaattgatcagatgctgtccatgattcaacaggccgacaatctactggcgcaacttgacccgaatatcgacttcaactcacccacatggcaggccatcaagcaactgctcgcgcgccttggcattaccctgcctgaagtgccgtcaatcagtgagctgcggcaacagctggccgccaagcaaacggaactgcaaacgcagcgagacagtctgacccagcagaaagccgatttgcagcgcacattaaacgaaaccattgcccccgcacaatccaccttggaccagcagaacgcgcaactgaccgccaaggaacaggaagcggctgcaggagaggcacagctcaataccaaatccgcggaacttgaagcgaatgccgcaaccctcgaaacccggtcggcgcaacttgaagcgcaggccgcccaactggccagcggcaagcggcagctcgaagaaggcgggcggcagctggaagaaggcgaacaacagctcgcggacggcaaggcgaaactggatgatgcgcagtctgaactcgatgcgaagcgaagcgaagcggaaagcgaattcgccaagcagcaacggcgcatcgacgatgtggccaacgcacgttggtatgtgcagacgcgcgcttcgatcgacggattcagctcgctcaaatcagacgtcagttccatcgaatccatcggccgcgcattcccgattgtgttcctgctggtcgccgtgctcatgagcctgaccaccatgacccgcatggtcgaggaagaccgcggacttatcggcacctaccttggactcggctatggcggactcgccgtgtccagccggtatctgctgttcgcgttgctcgcctgcctggtcggcggcggcatcggtctgctggtcggattccttggcatcccggcattcctgctggtggtgattgagggactgtatatattgcccggtgtgcgactcgaatacgactggctgtacggttcggccggcatcgtgctgttcgtggtcggcgtgggcgtggccaccgcgctcgcctgtcgcgaggagatacggcacacgcccgccgcgctgatgcggccgaaggcaccgaaagcgggcgctcgcatattgctggagcggattcgcccggtatggagccggctgaacttcctcggcaaagtcaccgcgcgcaatatcttccgattcaagtcgcgcttgattatgaccgtgggcggcgtggccggttgcacagcgttgattatctgcggatttgcgattaatgacaccgtcgacacgattggcgtcaaacaatacgagcagatctaccagtacgacctgatggtcgtggccaatgacgatgacgccaccgcgatgcgcaagcaggtggcacaagatggccaaaccaccgaaacgctgaatctgcgcgtggatagtggcgagatgagcaatgcggcgcaggaaagcgaaaccgtgcagctgatgaccgtgcccaacgattcgctgaatatcttgaacgatatggtcacgctggaacaagctggcgatgatggatggtttgggctgcccaatatcttcggcaaagcgggtggcggcactgtagcgttggacgatagtggcgtgattgtgtcgcagtccgccgccaactcgctgaatattcatgccggcgacaccgtcacgctgggcaatggcggcagcagccgggccaaggtgcaggtcgcggccgtgacgcgcaatcttattggctctgatgtgtacatcagtgagcgactgtacgaccagaagtttgcggccggcggtgtgacgtcttcggcttcgggagatggcactgcctcgaccttgacgtggaacgcgatgctcgccaagctgaaaggttccgagaccgaacaggccgaatatgcggatcggttgggcgaggaatcgtcggtgctcaaggccgtgagctgtgcgcatctggccgccacgtttaagttcgatttgatgggtgccgtggtggcgctgattgtggggctcgccggcggcctggcgctggtggtgctgtttacgttggccaatacgaacgtgtccgaacgcatccgcgagatggccacactgaaggtgctgggcttctatgaccgcgaggtgcacaactacgtgaaccgcgagatgatgatattgaccggtatgggtgtggtggttggtctgccgcttggcaggtggataggtggattactgactgctgcgttgaatatgccgtcgctgtatttcgaagtggaagtgcactggtacagctatgcgattgccgtggtggcgacgctggcgttcgcgctgctggtgcagctgttcaccaacccagtgctcgatcgcgtagacccggtcagctcgctcaagtccgtggaatagaggtagaagttcaatttggtgttgatgaattgaactttttggcggaatatttacagtatcatcgcatgtattcttgagctgagcggttttcgtgacatatttcggtgatacagtttgagcttgttttgaacgagtatcgcgtctggtgcgtaacaatcgggcggcagagaagagaaatgaaatcagtatggccgatacgaatgtgaatggtggtacacagcaggctacgggcaaactcaagtctgtcgaaagcctggaccagaccaacgagatggagcgtggcctgagcaatcgccacgtacagttcatcgccattggcggcaccatcggcaccggcctgttcctgggctcgggcaagtcaatctcgctaaccggcccctcgatcatcttcgtgtacattctggtcggtgtcatcatgttcttcctgatgcgcgccatcggcgaaatgatgtaccgtgaccccagccagcacaccttcatcaatttcatcacccgttaccttggcaacgggtgggggcatttcgccggctggacgtattgggccgcgctcgtgctgctgggcatgaccgagatcacggccgtctccacgtacttcatcaccttcttcgacacgttcggcatcgacctgacccattggaaatggctgatcgagctgtgtttcctggtgtcgctggtctccatcaacctgattgccgtcaaggtgttcggcgaggtggaattctggttctcgatgatcaagatcacgctgatttgcgcgatgatcgccaccgccgtggtcatgatcgtgatcggctaccattacccagccgtgcagattcacggcgtggaccacgtgagcccggccggccacgccggattcgacaacctgttcgccaacttctcgttcgcgccgaacggttggatggccttcctcatgagcttccagatggtgttcttcgcctacgagatgattgaattcgtgggcgtcaccgtctccgagaccaagaatccgcgcaaggtgctgcccaaggccatcaacgagattatcgtgcgcgtgctcatcttctatgtgggcgcactggtggccatcatg

SEQ ID NO: 25 - DNA, 2691647 bp, Bifidobacterium longum (residues 1,345,825-2,691,647 of 2,691,647)
  modified_base (207662)..(207757): a, c, t, g, unknown or other
  modified_base (1033488)..(1033583): a, c, t, g, unknown or other
  modified_base (1407334)..(1407431): a, c, t, g, unknown or other
  modified_base (2217268)..(2217313): a, c, t, g, unknown or other
  modified_base (2223078)..(2223187): a, c, t, g, unknown or other
  modified_base (2223724)..(2223826): a, c, t, g, unknown or other
  modified_base (2224206)..(2224288): a, c, t, g, unknown or other
  modified_base (2224598)..(2224607): a, c, t, g, unknown or other
  modified_base (2225123)..(2225132): a, c, t, g, unknown or other
  modified_base (2225858)..(2225867): a, c, t, g, unknown or other
  modified_base (2239052)..(2239088): a, c, t, g, unknown or other
  modified_base (2239397)..(2239406): a, c, t, g, unknown or other
  modified_base (2239817)..(2240013): a, c, t, g, unknown or other
  modified_base (2241715)..(2241724): a, c, t, g, unknown or other
  modified_base (2244427)..(2244465): a, c, t, g, unknown or other
  modified_base (2246458)..(2246467): a, c, t, g, unknown or other
  modified_base (2246898)..(2246933): a, c, t, g, unknown or other
  modified_base (2266535)..(2266549): a, c, t, g, unknown or other
  modified_base (2267960)..(2268090): a, c, t, g, unknown or other
  modified_base (2269203)..(2269317): a, c, t, g, unknown or other
  modified_base (2270250)..(2270259): a, c, t, g, unknown or other
  modified_base (2270721)..(2270730): a, c, t, g, unknown or other
  modified_base (2271208)..(2271292): a, c, t, g, unknown or other
  modified_base (2275527)..(2275600): a, c, t, g, unknown or other
  modified_base (2276137)..(2276224): a, c, t, g, unknown or other
  modified_base (2277302)..(2277366): a, c, t, g, unknown or other
  modified_base (2278013)..(2278101): a, c, t, g, unknown or other
  modified_base (2282838)..(2282923): a, c, t, g, unknown or other
  modified_base (2283981)..(2284008): a, c, t, g, unknown or other
  modified_base (2284319)..(2284358): a, c, t, g, unknown or other
  modified_base (2285445)..(2285454): a, c, t, g, unknown or other
  modified_base (2287883)..(2287934): a, c, t, g, unknown or other
  modified_base (2288956)..(2288989): a, c, t, g, unknown or other
  modified_base (2289461)..(2289536): a, c, t, g, unknown or other
  modified_base (2290817)..(2290882): a, c, t, g, unknown or other
  modified_base (2291239)..(2291297): a, c, t, g, unknown or other
  modified_base (2293503)..(2293555): a, c, t, g, unknown or other
  modified_base (2295573)..(2295612): a, c, t, g, unknown or other
  modified_base (2297577)..(2297654): a, c, t, g, unknown or other
  modified_base (2298419)..(2298428): a, c, t, g, unknown or other
  modified_base (2299801)..(2299856): a, c, t, g, unknown or other
  modified_base (2303354)..(2303363): a, c, t, g, unknown or other
  modified_base (2313698)..(2313707): a, c, t, g, unknown or other
  modified_base (2314153)..(2314163): a, c, t, g, unknown or other
  modified_base (2314571)..(2314618): a, c, t, g, unknown or other
  modified_base (2315528)..(2315541): a, c, t, g, unknown or other
  modified_base (2324392)..(2324475): a, c, t, g, unknown or other
  modified_base (2326881)..(2326890): a, c, t, g, unknown or other
  modified_base (2333611)..(2333740): a, c, t, g, unknown or other
  modified_base (2335193)..(2335237): a, c, t, g, unknown or other
  modified_base (2335534)..(2335665): a, c, t, g, unknown or other
  modified_base (2336251)..(2336266): a, c, t, g, unknown or other
  modified_base (2339776)..(2339870): a, c, t, g, unknown or other
  modified_base (2344083)..(2344092): a, c, t, g, unknown or other
  modified_base (2344651)..(2344766): a, c, t, g, unknown or other
  modified_base (2345611)..(2345676): a, c, t, g, unknown or other
  modified_base (2347011)..(2347020): a, c, t, g, unknown or other
  modified_base (2350905)..(2351028): a, c, t, g, unknown or other
  modified_base (2351614)..(2351711): a, c, t, g, unknown or other
  modified_base (2352537)..(2352601): a, c, t, g, unknown or other
  modified_base (2354162)..(2354171): a, c, t, g, unknown or other
  modified_base (2354450)..(2354534): a, c, t, g, unknown or other
  modified_base (2355318)..(2355404): a, c, t, g, unknown or other
  modified_base (2356004)..(2356121): a, c, t, g, unknown or other
  modified_base (2357042)..(2357087): a, c, t, g, unknown or other
  modified_base (2358740)..(2358769): a, c, t, g, unknown or other
  modified_base (2359159)..(2359175): a, c, t, g, unknown or other
  modified_base (2360254)..(2360295): a, c, t, g, unknown or other
  modified_base (2362214)..(2362223): a, c, t, g, unknown or other
  modified_base (2364800)..(2364874): a, c, t, g, unknown or other
  modified_base (2367490)..(2367529): a, c, t, g, unknown or other
  modified_base (2368599)..(2368616): a, c, t, g, unknown or other
  modified_base (2370771)..(2370816): a, c, t, g, unknown or other
  modified_base (2372064)..(2372073): a, c, t, g, unknown or other
  modified_base (2372339)..(2372394): a, c, t, g, unknown or other
  modified_base (2373493)..(2373547): a, c, t, g, unknown or other
  modified_base (2375150)..(2375294): a, c, t, g, unknown or other
  modified_base (2378218)..(2378363): a, c, t, g, unknown or other
  modified_base (2381594)..(2381645): a, c, t, g, unknown or other
  modified_base (2383346)..(2383441): a, c, t, g, unknown or other
  modified_base (2385046)..(2385124): a, c, t, g, unknown or other
  modified_base (2386435)..(2386487): a, c, t, g, unknown or other
  modified_base (2390127)..(2390159): a, c, t, g, unknown or other
  modified_base (2391065)..(2391152): a, c, t, g, unknown or other
  modified_base (2394720)..(2394896): a, c, t, g, unknown or other
  modified_base (2395492)..(2395501): a, c, t, g, unknown or other
  modified_base (2396620)..(2396707): a, c, t, g, unknown or other
  modified_base (2397889)..(2397908): a, c, t, g, unknown or other
  modified_base (2398331)..(2398441): a, c, t, g, unknown or other
  modified_base (2399168)..(2399177): a, c, t, g, unknown or other
  modified_base (2404578)..(2404710): a, c, t, g, unknown or other
  modified_base (2405658)..(2405722): a, c, t, g, unknown or other
  modified_base (2406159)..(2406201): a, c, t, g, unknown or other
  modified_base (2412396)..(2412491): a, c, t, g, unknown or other
  modified_base (2415046)..(2415223): a, c, t, g, unknown or other
  modified_base (2420614)..(2420623): a, c, t, g, unknown or other
  modified_base (2422821)..(2422953): a, c, t, g, unknown or other
  modified_base (2424037)..(2424125): a, c, t, g, unknown or other
  modified_base (2425646)..(2425709): a, c, t, g, unknown or other
  modified_base (2426045)..(2426121): a, c, t, g, unknown or other
  modified_base (2426432)..(2426478): a, c, t, g, unknown or other
  modified_base (2427465)..(2427492): a, c, t, g, unknown or other
  modified_base (2428045)..(2428054): a, c, t, g, unknown or other
  modified_base (2431188)..(2431197): a, c, t, g, unknown or other
  modified_base (2431846)..(2431939): a, c, t, g, unknown or other
  modified_base (2432318)..(2432436): a, c, t, g, unknown or other
  modified_base (2434417)..(2434447): a, c, t, g, unknown or other
  modified_base (2435795)..(2435825): a, c, t, g, unknown or other
  modified_base (2442043)..(2442066): a, c, t, g, unknown or other
  modified_base (2442563)..(2442572): a, c, t, g, unknown or other
  modified_base (2447768)..(2447834): a, c, t, g, unknown or other
  modified_base (2448396)..(2448434): a, c, t, g, unknown or other
  modified_base (2449011)..(2449020): a, c, t, g, unknown or other
  modified_base (2449348)..(2449403): a, c, t, g, unknown or other
  modified_base (2454503)..(2454512): a, c, t, g, unknown or other
  modified_base (2462539)..(2462548): a, c, t, g, unknown or other
  modified_base (2463655)..(2463730): a, c, t, g, unknown or other
  modified_base (2464309)..(2464477): a, c, t, g, unknown or other
  modified_base (2465276)..(2465285): a, c, t, g, unknown or other
  modified_base (2465580)..(2465723): a, c, t, g, unknown or other
  modified_base (2469931)..(2470090): a, c, t, g, unknown or other
  modified_base (2474435)..(2474456): a, c, t, g, unknown or other
  modified_base (2474788)..(2474900): a, c, t, g, unknown or other
  modified_base (2475771)..(2475828): a, c, t, g, unknown or other
  modified_base (2478326)..(2478349): a, c, t, g, unknown or other
  modified_base (2483201)..(2483210): a, c, t, g, unknown or other
  modified_base (2483829)..(2483908): a, c, t, g, unknown or other
  modified_base (2484519)..(2484556): a, c, t, g, unknown or other
  modified_base (2489185)..(2489251): a, c, t, g, unknown or other
  modified_base (2490581)..(2490700): a, c, t, g, unknown or other
  modified_base (2494301)..(2494458): a, c, t, g, unknown or other
  modified_base (2495692)..(2495739): a, c, t, g, unknown or other
  modified_base (2497227)..(2497416): a, c, t, g, unknown or other
  modified_base (2497722)..(2497924): a, c, t, g, unknown or other
  modified_base (2502545)..(2502594): a, c, t, g, unknown or other
  modified_base (2503385)..(2503412): a, c, t, g, unknown or other
  modified_base (2504328)..(2504491): a, c, t, g, unknown or other
  modified_base (2505157)..(2505233): a, c, t, g, unknown or other
  modified_base (2512292)..(2512301): a, c, t, g, unknown or other
  modified_base (2513115)..(2513188): a, c, t, g, unknown or other
  modified_base (2515314)..(2515408): a, c, t, g, unknown or other
  modified_base (2516409)..(2516448): a, c, t, g, unknown or other
  modified_base (2517252)..(2517341): a, c, t, g, unknown or other
  modified_base (2520552)..(2520604): a, c, t, g, unknown or other
  modified_base (2521018)..(2521055): a, c, t, g, unknown or other
  modified_base (2521651)..(2521674): a, c, t, g, unknown or other
  modified_base (2521971)..(2521980): a, c, t, g, unknown or other
  modified_base (2522781)..(2522862): a, c, t, g, unknown or other
  modified_base (2525050)..(2525184): a, c, t, g, unknown or other
  modified_base (2525887)..(2525950): a, c, t, g, unknown or other
  modified_base (2532956)..(2532970): a, c, t, g, unknown or other
  modified_base (2534082)..(2534091): a, c, t, g, unknown or other
  modified_base (2536893)..(2536973): a, c, t, g, unknown or other
  modified_base (2538635)..(2538771): a, c, t, g, unknown or other
  modified_base (2539384)..(2539442): a, c, t, g, unknown or other
  modified_base (2541569)..(2541642): a, c, t, g, unknown or other
  modified_base (2542845)..(2542925): a, c, t, g, unknown or other
  modified_base (2546471)..(2546636): a, c, t, g, unknown or other
  modified_base (2549818)..(2550010): a, c, t, g, unknown or other
  modified_base (2553399)..(2553471): a, c, t, g, unknown or other
  modified_base (2553870)..(2554072): a, c, t, g, unknown or other
  modified_base (2558574)..(2558727): a, c, t, g, unknown or other
  modified_base (2559795)..(2559845): a, c, t, g, unknown or other
  modified_base (2563597)..(2563764): a, c, t, g, unknown or other
  modified_base (2564400)..(2564517): a, c, t, g, unknown or other
  modified_base (2564975)..(2565050): a, c, t, g, unknown or other
  modified_base (2567310)..(2567342): a, c, t, g, unknown or other
  modified_base (2569177)..(2569261): a, c, t, g, unknown or other
  modified_base (2573887)..(2573991): a, c, t, g, unknown or other
  modified_base (2575689)..(2575713): a, c, t, g, unknown or other
  modified_base (2577752)..(2577761): a, c, t, g, unknown or other
  modified_base (2579340)..(2579483): a, c, t, g, unknown or other
  modified_base (2580287)..(2580314): a, c, t, g, unknown or other
  modified_base (2585366)..(2585394): a, c, t, g, unknown or other
  modified_base (2587179)..(2587217): a, c, t, g, unknown or other
  modified_base (2589109)..(2589137): a, c, t, g, unknown or other
  modified_base (2589514)..(2589583): a, c, t, g, unknown or other
  modified_base (2593958)..(2593967): a, c, t, g, unknown or other
  modified_base (2594336)..(2594462): a, c, t, g, unknown or other
  modified_base (2594996)..(2595142): a, c, t, g, unknown or other
  modified_base (2595489)..(2595498): a, c, t, g, unknown or other
  modified_base (2597021)..(2597145): a, c, t, g, unknown or other
  modified_base (2597414)..(2597525): a, c, t, g, unknown or other
  modified_base (2603531)..(2603743): a, c, t, g, unknown or other
  modified_base (2608231)..(2608317): a, c, t, g, unknown or other
  modified_base (2609359)..(2609406): a, c, t, g, unknown or other
  modified_base (2610262)..(2610474): a, c, t, g, unknown or other
  modified_base (2611783)..(2611869): a, c, t, g, unknown or other
  modified_base (2612227)..(2612366): a, c, t, g, unknown or other
  modified_base (2615590)..(2615599): a, c, t, g, unknown or other
  modified_base (2617770)..(2617897): a, c, t, g, unknown or other
  modified_base (2620490)..(2620506): a, c, t, g, unknown or other
  modified_base (2620934)..(2620981): a, c, t, g, unknown or other
  modified_base (2621979)..(2621988): a, c, t, g, unknown or other
  modified_base (2624797)..(2624824): a, c, t, g, unknown or other
  modified_base (2628315)..(2628324): a, c, t, g, unknown or other
  modified_base (2629051)..(2629186): a, c, t, g, unknown or other
  modified_base (2629534)..(2629583): a, c, t, g, unknown or other
  modified_base (2630580)..(2630623): a, c, t, g, unknown or other
  modified_base (2633163)..(2633195): a, c, t, g, unknown or other
  modified_base (2633566)..(2633575): a, c, t, g, unknown or other
  modified_base (2636241)..(2636374): a, c, t, g, unknown or other
  modified_base (2638931)..(2638996): a, c, t, g, unknown or other
  modified_base (2648691)..(2648749): a, c, t, g, unknown or other
  modified_base (2649039)..(2649156): a, c, t, g, unknown or other
  modified_base (2652779)..(2652816): a, c, t, g, unknown or other
  modified_base (2653564)..(2653743): a, c, t, g, unknown or other
  modified_base (2654051)..(2654188): a, c, t, g, unknown or other
  modified_base (2654675)..(2654721): a, c, t, g, unknown or other
  modified_base (2658488)..(2658501): a, c, t, g, unknown or other
  modified_base (2660978)..(2660992): a, c, t, g, unknown or other
  modified_base (2662465)..(2662474): a, c, t, g, unknown or other
  modified_base (2664488)..(2664508): a, c, t, g, unknown or other
  modified_base (2664866)..(2664875): a, c, t, g, unknown or other
  modified_base (2667896)..(2668084): a, c, t, g, unknown or other
  modified_base (2668359)..(2668368): a, c, t, g, unknown or other
  modified_base (2670681)..(2670848): a, c, t, g, unknown or other
  modified_base (2679230)..(2679301): a, c, t, g, unknown or other
  modified_base (2682586)..(2682595): a, c, t, g, unknown or other
  modified_base (2689898)..(2689907): a, c, t, g, unknown or other
  modified_base (2690243)..(2690274): a, c, t, g, unknown or other
  modified_base (2690904)..(2690928): a, c, t, g, unknown or other
tgcatcgtgccgtggacctcgttcaagccgaacgaggacggctcctttgcctccccgttcattatggtgttccagtacgccgggctgaattgggcgtccgcgctggtgttcttcgtggtgatcaccgccgcatcttccgcgctgaactcgctgctgtactcggctggccgccacctgtaccagctgtccgaggtgtcgccgaacccgatgctgaacaagctcggcaaggtgtccgatcgcaaggtgccggcccgcgccatcctggtgtccgcggcgctgatactgctgtcgccgatcgtcaacgccatccccggtgtgtccggagcgttcgtgctgttctcgtccgccagctccgcggtgttcctgttcatctacatcctgacgctgctggcgcatcgcaggtaccgccgttccgctgatttcattccggacgggttcgtcatgcccgcgtggaaggtgctcaatacggtggcaatcgtgttcttcgtgttcatctacctgacgttgttccttgcggacgatacgcgcaattccgcgattgccggcctggtgtggcttgtgggcttcggtggattctctatgctgcgcgaacgctaccgtagccgcgatttgaaggccgcactggaacacaaggagtgattggacgggctgattggctggcggctattggttgggtggctgttggctgttggcggctgactggctagcggccgatagccaatgactgggctgatcgtcagccaatcggctgcctataggtctcattgatacattcggtcatccgattagtgcatttgcgcggacaattagtgcattcgatcatcggattagtacatcagtgtgcaattattagtacaattagccgcctaattagtacattaggacataaaacaatgtcctaatgtactaattagatgctaaaatacgataagtgccatgtcctaatgtatgaattatcgctatgaagggcggaatgcgatgacgcaggatgaacttatgcaagtgctgcaggccggtgaatcatctatggtcgagttcaagcgctgcagcgaattgcctcatacggatacttttgagactgtatgctcattcgccaatcgttctggtggcagcatttatcttggcgttgacgatgacggtcaagtgctcggcgtcgattctaagcgcgttagtgagatagagcgcaacgttgtcaacgtagtgtctaatcgtaagatgttcgaaccggctccaatggtggaaacggaacatatcgagtacgacgaacggattattgttcgtatttgggtagctccgagttcttcggttgtgcggttcaagggcgcagtgtttgatcgcattgctgatgtggatacacacatcgaaagcgatatccagattagtcaaatgtatattcgcaagcagaactactattccgaacggcgaattttccgttacgtgactccgtttgatttgcgtcctgagctgattgcgcgaatgcggcagctggcggtcgctcagcgagctgggcacccttggggaactatgtctgacgaagaactgttccgcagcgccaagctatacgatcgtgattacacgaccggcgaagagggctttaatcttgctgcagtgctgctcttgggcaaggatgaagtcatttcctcggtttgcccagcgtatattactgatgccgtggttcggcgagacaatattgaccgatacgatgaccgacttatggtgcggaccaacttgttcgattcgtacgagcaactccgtgaatttactgagcggaatctgcctgaccgctttgtgttaaagggcgataagcgagtgagcccgcgtacgatgatcgcccgtgaattggtggcaaacagcctcatgcatcgggagtattccagtccggtggtggcgcgtgtcaccattgataatgaatccatccggacggttaatgcttcgcgctcattctttgaaggtcgaatgaagctgggcgagttcacgccaatgccaaagaatccgattatcgctaatgtgtttgtgcagaccggcatagccgagcagctgggtagcggactgcggaatctgataagagcgtcccggcaatatactgagcgagagcctgagttccgcgatggtgacatattcgaggcgacgattcctattgttcctgcgctgaagaccgtggatggttctggttttgctagcgtgagatctgtagttgagaaagatgccgaagagggtgcgaggctcattggcggggaacgtgtggatggtaagaaagcagatgcaaccgcatcgggtgaaattgattcgcgggcagcgatgctgtcggcgatgaatcgacgcttgacagaggttgactatgtgactgtacctgaactcgccaagataacagagctcgataacagaacagtccgcaaattcctaaacggtttagttgcgcaaggaaagctgattgctgaaggcaacacgcgtggtcggcgttatcggaagggatagcgggcgcgatatctcgatgcagtgggattcacttaagggctacggcaaatatgattcgtagcgattgggccagcgcaattcgaatggctcatgactttgtgcgtcgtttgtggtctctgaagttgtttgctgggtgacggttttgtgataaaatcgctcatatcaaaatgtttgcgtaaacattttggctgcgccgaaagaaggagtcgacgtaggtcatgtatcaggcaaagaggccggctcagtgaagcaaaggccgatttttccggtataaggcggacagcaggaacactaaggagaccaatgaaggtactgagcaaatcgcttgctgcaatggttgcggcggcaacactagtgggaggaggggcgtttgcggttgccggcactgcgtatgcggctgataacgatgccattaccgtgaccccgaacccgtggtatgccaacagtttcgatggctggggcacctcactggcttggttcgccaacgccaccggcagcctcggcgaggaatcggccatcaccaccaatctcggcgatgacgcttccaaggctaaggctgtggaatacggcaaacagctgcgcgaacagttctaccagtccatcttcggtgatgaaggactggacctgaacatggcccgctacaacgtgggcggcggcaatgcctccgatgttgcctacggctacccattcatgcgccaaggcgctgccgtgcctggcacgtggaaagatgacgccaccggctccggcacgtatggcaatggcgtaaccaccaagcaggccgacaaagacaagctggctgcggcattcgacccgactgacgacaaccagtatgacttctccaagtccgccgcccaagactggtggattgagcgcggtgccaccggcgataaccctgacatcaccgacgtagaggccttcgccaactccgctccgtggttcctgaccaacagcggttacgccactggtggacgcaactccggtagcaataatcttgcaaaccctgagaaattcgctcagtacatggccaagaacgtcgagcacctcgaaagccttggcgcaaacgttgacacggtcgagccgttcaacgagtccgagaccagttactggggcactccgggcgacatggcttcgaagtacaccgatgagagcgatgacaacaccaagctcattaacaactactgggataagtactactccgacaaagataggtccgtcaccccatactccaacgcgctgaagaagccgcaggagggtatgcatgtcagcaacgcccagcagcagcagacgattaccgcactcgctgaggcgctcaaggacaatgatgacaccatcatcgcagccaccgatgccacgaactccgccgacttcgtcaagtcgtacaaccagtacccgcaggcgatcaaggaccttatcggccagtacaacgttcacgcctactccgacagcaaccagatgcaatcgcgcgatatcgctcaggcagacggcaagaagctgtcgatgagcgaggtggacggctcctggcagtccggctcctacaacccgtacggtttcgacaacgcgctgggcatgatgagcaagatcagctccaacgtcacccgcctgcagtccaaggacttcaccttctggcaggtggtcgaggacctctacaacatgcagatgggctcgaacgtgaacccggcaggtgaaaacaccaactggggcaccgtgctcatcgacttcgactgcaccgtggccggtaaggacggcaagctctactccgagcgtcgcgtgaacaacaacggcggtaccaccgatggacttgaaccgtgcacggttattgccaacgccaagtacaacggcgtcaaggccatcacccacttcatccacgcgggcgacaaggtcatcgccaacaacgatgaggacaacaacatgaccgccacctccgccgatggcaagacacagaccgtcatccaccgcaactccggcacctctgaccagaccttcgtcatcgacctgtcgaagtacggcgagattgccgacaacgcttacggtgagctctatctgaccaccgaaacctctgccgaagacaagaacgcgggtgtcgattccgccactccggaagtcttcgccaagaccagcaacgtcaagcaagctgaaggctctgtggtgattgacaaggctgccaagaccgctacggtcactgtgcccgcccgttctatcgcctccatccagctcactggcgtgaccggctacgctaaggatgctgccgtcgagaccggcgacacttaccagctcgttggtaagcagtccggcaaggccgtggctgataccacttctggtgattccgcgctgtccctggccaacgtcgcttccgatgccgagaacgccaagaagcagacttggacctttacccagatcgagcagcccaccgactccgagcgccctgatctcaaggcttatgtgattactaacgccgaaggcaaggtgctggtgtccaaggatggcacgaacgcgctttccaacgaaacggttggggccgctaaatccgacccggctgccaagtggattctcaacacttccgatggttcgacctaccagctgctcaatgccgcgactaagacgaaccttgatgtggataactctggtaccacagtcggcacgaaggttggcttgtggcagtcaccgagcggcacttcgccgtccgccaaccagacatggactctgcgcaatgtaacgccgaccagccagaagaccgtgaacgtgcagaccgccgttaacgagaaggccgtgcttccggtcgaagtcacgctctactacacctggggcgaaggcaaggcaacggtcgccgattgggatacttccaaggtcgatgtggccaaggaaggcacctacgagtccaccgccactgccgccgacgtatacggcaatgagttcaacgtcaccgccacggtctacgttggtgccttcactgtttccgatccggtatccgccacagtgctggccggcaccagtgcaagcaacgccaaggctgcgcttgaggctgagccggtgtacctgcacgtcaaggcatcgcctgcatttgaaggtgatgcggctaaggttacttggaacttcgatgggcttgatgccaagctcgccgaggccaaggctggcgacaacattgccgtggccggtacctaccagctggacgacacgaccacgattgcgctgaagggtacgatctatgtcaccgccgccacgcctgagaatgtggccgacactgcttccaacctgactgtgaccaaccagcagacggaatacagcaagggcgaccagtggaagaagctcaccgatgacgatacgtcggccgaggcttgggtgacgtggaacgcaaagaatgattactctgccagcccgaccgccacggtgaacttcggcgaagagcgagaagtcaccggcctgaccatcacctatggtgacaaggctccggcatccgccaaggctgagtacaccactgatggcaccacatggacgcagttcggcagcgaggtcaagcccaaagccgggcagactgttacgttcactcctgaagatggttcactcaaggccacgcaggtgcgtatcgtcaacacgcagaacggcgacttcatgaacgctaccgagatcgaagcctttgtggttccggttgtcggaggcgtgaagaacatcgccgcggcctctggcacgaacttctcggtgaacttccaggagggtgcctccgcttccaaggccatcgatggtgacactacgtcaaagggttggtccacttgggcttccaccgcctcgacggtggacccggtcgccacgttcaccttcgacgaagctcagaccatcaccgaagtgaagaccttcttctactacgatggtcgtgcgtcttggccgaagagccagacgctggaataccaggatgaggctggcaaacggcatgaagtcggtaccaaggatggctggaagacacaggccggcgatgccggctctggctccgacggcatcaccgccgccgacaccccgaccgttgacttcgtgctcgacaccccggtaaaggccaaggccatccgcctgaccaacacgttgcaggacaccaaggtgtacatcaacgtggccgaaattcaggtgttcgcacaagacaacaaggtgattaccccgcagccggcatccgatgccacgctgggcgacctgcgtcttgacggcgagaccatcaagggcttcgctgctgataagaccgactacacagttgatcttccgttcggtgctgaggcaaacccggtgctgcaggccttcgccgccgacaatgccgccaccgtcaaggtgactggcgacgcggttgagaatggcaagcttggcggcaaggccaccattacggtgacctcagccgacgagtctgagacgaagacctacacggtgaccttcaaagccttcactttggcttcgctcaaggtgaccggacccacgaagatcgagtacgccatcggcgacaagctcgataccgccggtctgaaggttactgccgtctatcagagtggcgacaagaccaaggaagtgccggtcgctcttgacgacccgcagcttgcgattggctcgttcgactccaccaccgcaggcaagaaggcgattaccgtctcctaccgtggtgtgaccgcgaccttcaacgtcacggtcaaggccaacgcagtcgcccctggccctgaagaacagaagcccggcagcaccaacaagcccggtgccaccggcaacggcaacaagaacacggtggccaacaccggttccaatgttgccgccatcgctggcgctgtcgctctgctggccgctgccgcgggtgcattgttcatgctgcgcaagcgtgcatagcaccctcgcacagtaatgggggaaggaacaagccggcaatattgactattgccggccggttcctccgctctttgagcataattggtccgacaagttgaatactgagttttcagtatcggtatattgatttgtcggcccttttctgacttcgcggatagcgacataactgtttgttcaaaaaaccgttatcatcaatcaaggaaccaaatcaatgaagataaacaataagggcaagggcgctcttatcgcggcaattaccgccgcggcaacgctattgtcatgcgggctggccgctgcaagtgccagtgcggcaggtgtggattacctgcctaccatcggccaagtgccgacatacaccaagttccagcccacagccgatccgggcaagaacgctagcgattacttccagccatattggtatgccaagaacgccaatgataatggcggcacacacatccaagcgcacggtggccaagtggtcaaggtcggcgacgcctactactggtatggcgaagaccgttctaacggttacgacaacagccccggtgttcatgcttatatgtcgacagatctatacaactggaccgatcttggtgtggcgctgcgtgcggtgaccagcaaatctcagttgacggataagagcaatgccgattacgcctacttcgacaaggcctacaacctgaccaagtccgacggcagtgtggacgctgccaaggccgacgcaatcttcccgtacctcaacaccaaccccgatcaggatggtgatggcgcggttgattccgtacagggcattttcgagcgtccgaagatcatctacaacaagaagaacaagcaatacgtgctgtggtggcattccgatggaagcaccacgccgggcggttccaactatgcacgtgcacttgcgggcgtggctgtttccgacaatccggcgggcccgttcactatggtgggtgcctatcgtttgcctaaccagaacaattggaaagaagccgcaggtaaccccagctggggtgagaacggtgacagccgcgatatgactgtgttcgtggatccgaaggacgacagtgcctatgtactgtattcttccgaagccaatgccacgctgtatatcgccaagcttaacgatgattacaccaatgtagtcaagaccacgaatgtggaccagtccgagggacaaaagcagtactctgctgacgggcagtacccatacattcttgcagacggtactacggatgccccggtgcgtggcgaagatttccaaatcgtcaaacaaaatggttcgctggaagctcctgccgtattccaatatgacgggcgttacaacatcatcgcatctggtgcaaccggctgggacccgaacaagcagacctactacaccgccgactccatgctgggaagctggacccgtggcgtggaaaaggacgatgccaacgagaacacgtggtacaacaacatgccggaaggcgcggatggtctgttgtccgtgggcgatacccgcggcaccacattcggttcgcagtcggctagtgtgctcgcagtagaccaggagaaaggtcacttcatctaccttggtgaccgttgggattccggtaaagccgattccacctatgtttggctgccgctgaccatcggtgagaacggcaccatcgaaatgcataatcctgctcaagaaggcgagcccgacggctgggatctgaactattgggacaaccatggtagcgccaagggcaagctggtcaactggactgtggaaaccggcgatgatctcccgaagaccgtgaacacgggcggaaccgttactctgccggacaccgtcaacgtcaaggaaggcgacgataccattgctaccaaggtgacatggaatgtggaaggcggtacggcagtcagcaagtcgaccaaggctgccggcagcacctacgcattcaatgtgccgggaacctacaccattacaggcactcttgccgagagcagcaacttcaacccgggccgcacattccgcagaaccatcgacgtttcctgctccaacccgatttccggaagttggaaggaagcccattggaagggcggcagcgcgtgccaggtcgccgcatccggcggtacctatgacttcaccgttacggacaacgccaatcgtggcgtctggacggatcgcaacgagggcagcgcggtgtaccagcctgatgctctggacgtgaacgaaacgttggaaaccacggtcaagccgctcgacttgggcggtaatggcgatccgcgtgccggcctggtggttcgtaacggtcttgctgacgctaacggcggcaagggatatgccacgttacttgccagcccaagcggcatttacatgcagtacgattccaatgccgatggctacatcgataaggaaacatcgcatgttggtgccggcttcggcgaccaagtgcaactcaagctggagcgcgccgcaaccgataccctgaaaggctactggcgtgcttccgcgaacgatgaatggcaggatgtcgctacggtaacgctgaccggtgcggacgcaaccgggctcgatgccggtgtcttcgccacgtcgaacagcaatgccggcgcattcaccgtggccttcaacggcactgcgttcggttcgcagactgctgctgtggagtccatcgcggccaagggccctgaagccactatcgccaaggggcagatgctcgcgcttcgggacgtgacggttaccgccacgctcaccaatggcaaaacgcgtgtgctggagccaagcgaatacacgctggaaggcttcgacaccaccaaattgggcgagcaaaccgtgacggtgcgtcttgtcgctgattcttcagtaaccgccacgttcaccgtgactgtggaaagcaaccttgcccggttgttctgctcgtccgctgcggcctcgaagtatgagccggccagtagctgggcctccgcttctacggccgacctgacttgcgacaacaatctgagcaccaactggtcgaactggggcaccggcgacacctcgccgtggctcagctacaccttcgataaggcatatcagctgggcaagctcagcgttgcggtggataaggccaagggcgaggccgctccgaagagcttcactgtatcgtacctagctgaagacagcgccacgtggactgatgccacgctgccggcagtcactgtgaatggtgctgctggagccgtgacggaagccgatgtgagcgctctgcccgccaccaagggcattcgcctcaacttcacctacgccgatggcaatgactatgccaagatcgctgaagtacgcatcgccgaaggtgaagcaacgccaaagccgcagccgtctagtaacgccaatcttgctgatctgactgtggatggcaagacggttgacggattctccgcggatatcaccgaatatgccggtgcgctggccggagacgctgcttcttacccgacggtggaggcgactgctgctgacgcgaaggctacggtgcaggtggagcaggcttcgaccgagaacagcggcgtggccacggtgactgtaactgctgaggatggcacggcggaaacctacacagtgacattcggcgaactgcctcagttggccgagcttgctgtggaagtgaccaaggattcctatcaggtaggcgataagttcaacgctgccgatgtgaaggtatccgccatttacaaagtcggcgataccgaaacgctgcgcaagctgattgatccaactgatggtgatttgaagttcactggctttgattctgccaccgcaggcacgaagaccatcaccgtctcttatcgtggcgtgaacgcgacgttcgaagtcacggtcacggccacggaggtcactcccggccctggagagcagaagcccggcgataccaacaatcctggcaacactgctaagcccggtaacactgccacgaataagccggctgctaatggcgctgcgcccctttcgaatacgggtgttgccgtggctgccattgcggtcgtggttgtggtgctgacagctgcggctggtgccttgctcgtcatccgcaaacgccgcgcataaccatggcaactgctgagtggcgtggattgcgttgctattgagcaatctgcgattcacgccactcagcgagtgcacccgagtgcgcccgagcttgcgcaatgcaggcgcaatacagtgcaaacagtacaaagcaacaataatggccggtctgagccagctgctccatgcgagggcagctggctcagaccggccattgtgtctgcaagtacatgcaattagagcatgaacatgtggaagccgttgagcgttactggttgttttgctttgttgttgcgctcagcagtgcgacggacgtccgcccgcagtgtagtgcagcgctccgtgaaccagcgccgatgtgaaatgcatgttgcacatgcccgcttcttctgcttcgtgcgtgcagccggcgatgctgcataggttcataccccgaatcatggtcataccccctctttgggatggcatccgtgccgccatctgccttcagagcatagcggacaattgttgcattgcctaggcggtacaacgctttctgtggcctgtatcacatccttgccggcgttctgcggcgtggttgggcgtgtacatgtgctcttgtgcggttttgttgtgtgtgatttgggtatacggatagagtttcttctctgcagtggcaagggcctctcggccggcgagccggctgatttctcccatgcgttgctcaatgatttccgttttgcgagtctgaacggcaaaatagctctggagaagtgccacttcttctttctttggatcaccgttttgagcaatgagatagcaggcgtatcgggtgagcttgacgtccgcgatggagcgggtggcaccgctgccgagagtcacgtctcgcgtagtgtcacggaaatgggattcaacggatacgccggaattgtcgcaagcttgcttggctcgtgtaatagctttgctgaagttttcccatctgtcgtaccccatataggtcattagctcgcgtgcataccaatactcaactttggagtcctcggtggtgtgtgcgatagtgctgagttcgctggttttgcgtgtgatttcgtcgcggttcatgggtgtgtccttatgtttttcatgaccattttcgtgactccacgaaaatggtcaaagcgaataattgcaatggttttgaggtatgggcgcgctccgcccaactggtctgtcttcgtccgccttttcgaccagatacctcatggagcacaatgccaacgtcgctaccgttggcccagcaaatattcttagacgacgccccgaagtgaatatctatgcggctttcagaatatcaaagagcgtggagtgtgtgcattatgcgttccaaaaatagtttctagtggcgaattgtttacggtgtgagatattcttgggatgtttgcggcgctctgccgtgtagcgaatgggaatggatggtgctcttatgggatttgagcaggaagcagttagtgaactgtatgccagcgtgtggggcaatcgttcgacaatgcagagggaattcactcgtggagcccatggtgagcagttcgtgctccgggagctgtccatgaaggggacgcaaacgccatcgcaattggcatcggcgctgcaggccagttccggccgcatctccactgtgctgtcgtctctggagaaaaaaggctgggtcacgcgtgacattgattccaaggatcggcgcattattcgcgtgaatctcactgattccgggcgcgagcagtctcatcggatgatagaggaaatgcgttccgcaatttgctggattttctcgcaaatgggggagcggcgcacgcgcgaattcgttgacctggtgtctgagttcaccacatatatgtcgatttgccatccggggcggcctcggccgacggctgaacaagtgcgtgaggcattcgtggagcgggacaagcgcgtggctgaacacatggcagctaagcgcgcggaggctgagcgagactagcttcctcccgctggcgggtctctccctccgtcactgctgcgcggtgacacctccctcgtcagagggaggtaaaggtaattgaggacgctcacagcgaacatacagaagtgcgtataatatctcacagtgtaagtaatcaaacaatggaaactattaagacatcgtgaaccgataatcaccgataacccagccaacttaagaaccaatcgccaataaccaataaccaacccaaccaacacaaggggaaaccaatgtttcgcatcatgaaatacctctccaaagcggagatcggtcagatgctcatcgccctggtgaccatcgtcgggcaggtctacttcgacctgaaactgcccgactatatgtcagacatcaccacgctggtcgagacgccgggcagcgacatgaaggacatctggatcgcgggcggcaagatgctgctcatctcgctcggatccgtggcgtgtgccatcatcaccggctacatcgctgcgcgcgtggccgcctcgttcacccagcgtctgcgctcgctcgaattccgcaaggtcgagtccttcggcccggccgagatgagcaagttctccaccgccagcctcatcacccgttccaccaacgacgtcacgcaggtgcagatgttcatcaccatgggcctgcagctcatcgtcaagtcgccgatcatggccgtatgggccgtgtgcaagatcgccggcgaaggcttcgaatggacgctcgccaccggcatcgccgtggcggtcctgctggtgtccatcaccgtcatgatggccatggtcatgccgaagttcaaggtcatgcagaccctgaccgacaacatcaacctcgtggcccgcgagaacctcaccggcctgcgcgtggtgcgcgcctacaatgccgaggactaccaggaagccaaattcaccaaggccaacaaggacctcaccgagacccagctgttcaccaaccgcgtcatggcgttcatgatgccgttgatgaacaccgtcctgaacggcctgatgctcgccgtctactggatcggcgcttacctcatcgacgccgccgggctcaaggacaagctcaccgtgttctccaacatggtcgtgttctccaactactccgtgcaggtcatcatgagcttcctgctcatgagcatggtgttcgtgctctggccgcgcgccgacgtgtccgcgcagcgcatcatggaggtactcgacaccgagccgatcgtcgagaacggcaccaaaaccgccgccgacgtggccaaaaccggccagaggggcaccgtggaattccgcaacgtcagcttcacctacccggattcgcgcgaggcgatgctggaaggcatcaacttcaccgccgagcagggccagacggtggcgttcatcggctccaccggctccggcaagtcgtctcttatcaatctcgtgccgcgcttctatgacaccagccaaggccaggtgttggtcgacggcgtggacgtgcgcgactacgacctgaaggccctgcgcgacaagatcggctacgtgccgcagcagtccgtgctgttcaggggcaccgtggcctccaacgtgagctacggcgatcagccgggcgacccggcggaggtcgagatggccgatacctccaccccggccgggcgcaagcgcgaggccgcgttgatcgccgctggcgaggccgcggaaggtgccgatataccggccgagcagctgaatcgcgtcagggccgccgccgacgtggcgcaggccagcgagttcgtggcgcgcatggacggcgggtattccgccgcgatcgcccaaggcggatcgaacgtgtccggcggccagaagcagcgcctgtcgattgcgcgcgcggtgtaccgtcacccggaaatcctgattttcgacgactcgttctccgcgctcgacttcaagaccgaccgcgaagtgcgcgacgcgctcgcccgcgaggccaaggattccaccaagctcatcgtggcccagcgcatcggcaccatcatgaacgccgaccgcatcgtcgtgctcgacgacggcaaggtcgtgggtcagggcacgcacaaggaactgctcgacaactgcgacgtataccgccagatcgccgaatcccagctcagccagtcggagcttacggcgtaggggggcggcagcggtagctccccatgtcaggggctgagccgtaaagggaacagcccagtgggctgttcccaggcgaagacgagctgataagcgagcgaataaaacagcacagctgactgaggggtagtcgcgtacggcttctctccctccggcgcttcgcgccacctccttcatcagagggaggtcaatacggacttttaaggagtaaaacaaatgccaagaggaccaatgggcggcaggcgtgccgtcgaagagccccatgatttcggcaaagtcatgggcaaactcgtgaactactgccgcaactatcttcccgtcatcatcatcgcgctcatcctgggcgcggccggcaccgtctgccagatcgtcggcccggacaagctcaaggacatgaccaacgagatcgtcaaaggtctgcccgccatcgttaacggcagaccggtgatgaactcggtagatttcggcacggtgggccacatcgcctggactttggtggccctgtacgtgggctacgccgtgctcggctacgtgcaaagctggatgatggccaacgtcacccagcgcaccgcccagcgactgcgcgagtccatctcggtcaaaatcaacaaactgccgctcaaatacttcgacaaggttagctacggcgacgtgctgtcgcgcataaccaacgatgtggacgccatcggccagacgctgggccagtcgctcggctcgctgattacctcggtgacgctgttcgtgggcgcgctggtgatgatgttctacaacaacgtgatcatgaccctgtgcgccatcggtgccagcctcatcggcctgatcatcatgatggccatcatgaagtcctcccagaagtacttcgcccggcagcagatggcgctgggtgacgtcaacggccacgtggaggagatgtacgccggtcacctcatcgtcaaggcatacaacggcgaggccgattcgattcgtcgcttcgagaagtacaactcggacctctacgagtccggctggaagtcgcagttcctctccggcctgatgatgccgctcatgaatttcgtgggcaacttcggctacgtggtggtgtgcgtggtgggcgcggcgctcgcgctcgacgggcagatcgagttcggcgtgatcgtggcgttcatgatgtatgtccgcctgttcactcagccgctttcgcagtttgcgcaggccttccagaacctgcagcgctgcgcggccgccgccgagcgcgtgttcggcttccttgaagagccggagatggaagacgaatccggcaagtccgctttgcttgggaccaacggccacgaagtgaagggcgacgtggaattcagccacgtgcagttcggctacgagccgggcaagccgatcatccacgacttctccgcctccgtcaaggccgggcagaaggtcgccatcgtcggcccgaccggtgccggcaagaccaccatggtcaacctgctcatgcgcttctatgagatttccggcggctcgatcgcgattgacggcgtggacaccaagtccgtgccgcgctggaacgtgcacgaccagttctccatggtgctgcaggatacgtgggtgttccgcggcactgtgcgcgagaacatcgcctactccaagcccggcgtgaccgacaagcagatcgaggatgcgtgcaaggccgtgggcctcgaccacttcatccgctcgctgccggacggctatgacaccgtgctcgacgacaagtcgtcgctctcccagggccagaagcagctgctcaccatcgcccgtgcgatggtgcaggacgcgccgattctgattctcgacgaggccacctcatcggtcgatacccgcaccgaagagctgatccagaaggccatggacgcgctgaccgtggggcgtacgagctttgtgatcgcgcaccgcctctccacgattcgcgacgccgacatgattctcgtcatgaaccacggcgacgtgatcgagcgcggcacgcacgacgagctgctggcggcgggcggcttctacgccgacctgtacaacagccagttcgcactcgctgactgacggattgtttcctgcgttagcggattagcggattagctatactcggctcccctctccgaggggagccgtcagcgtagctgactgaggggagcaacccatcggtccacccgagggaatgctccactggatgtgatactgatgatttcgtacattagtgtgtgaaaaagccgccgggaaaattgggggattgggcggcggtgcggttggcgttgagaatggcgcattcgaaggggaagtgagcgcgcagctgggtggccggggtggtgaacagggcggtggcgaggccgtcggccagtgtgacagggacgtgtgccgcaacggtgttcgacgaatcgtcggtatcgcggtttgccgttgtcgaggcattgctgccatgcgtcgatgtcttcgtggttatggcgctcgatggcggcgtgacggccacccatgtggcggctacatcgtcaaccggtagtccgtcgatggcgttgagcagatggtgaagttggtgacctgcggcgtcagaccagtggcggcggctgggggagctcgcgcagaatgcgccgtggctgatttcgaccgtacctacggcgttggccggatcggcaggatcttcaagggcgatggtgattggttcgtccgtgtgcactagcaaatcacccccggcgtcgatgacgtattgaatgggttgagggtgacccgcgccatcacccaacatccccgcaagcaaatccaccaaataccccttaccgcacgcgccgaaatcgagcgcgaccggtccgcgcgtcaccagtgttgtgccatgccgctcaacgtcggctgaccaaatggctcgtccgtggatcgcgcctgcatgttcagcggcatctggcgcaggcgtaaacgaatacgactcgtcatagccaagccgaatcaaatcctcgcccacgcacgggtcggtcgccccatcggttgccgcaaacaggcggtcgtacaggccaaacagacccgatgcccagtcgggaaaatcgaacgtgccgccatgtgcggccgtgcgcatccggccgacgatggaatcatcgcggaatcgagataatacaacctcatattcatggatgaacgagccaatacgatcgcgtatctcatcgtccaatacgctctcggtgtgcaccagtaatccggtccccaacgcatcaggaaaagcgtatacgtatggcagttgctcggtcagacttgtcatgcccactatcgtagagcgcatggtgtgccggtgtatactggattttgacactgtgtcaatgttgattcggaggttgtgagaatgggcaatgcgactacagcaagtgtaacgggtgtgcaagttgcaccggcgaagtcagccatcagagatctccccatcgccaaagtgtgggcgtttgcggtcggccagttcgggtgggcgctgctttccggcatcatctccaactggctcgtgtatttctaccaacctgaccaggagaccatctcccaaggtcagaccgtattcgtgccgcagggcctggtcgttctcggcatcgtgaccgtggtgggcggcatcaccgccttcgcccgattcttcgacgcgttcgtggacccggccgtggcgtctctctccgaccgttgcgacgccaaatccggccgccgtatgccgttcctgaaattcgccgccctgccgctcgcggtggtcaccgtgctcgtgttctggagcccgatcaacggcgccagctgggtgaacgcggcgttcctgttcgtcaccgtgatcggctactacatcgccctcacgttctactgcacgccgtacaacgcgctcatcgccgaactcggccacgactccaagcagcaactcaccatctccaccgccatctccttcacttgggtggccggcacggccatcgcgtacgtggcgccggtgatttggggcgcgttcgtgccgatgatgggccgcatcaccgccatccgcgtgaccttcaccatcatggccgccgtggcgttcgtgtgcatgctggtgccgccgctggccatccgcgagaaggactacgtcaactcccatcccacctccgaatcgaccatcgaatccctgaagcagacgttcggcgacggcgaattccgcaagttcgtatgctccgacgtggtctactgggtggccatcaccaccttccagaccggtctgccgttcttcgtgaccagcctgctcaagctgccggaaaccaccacgaccatctacttcgtgctcatgaccggcgtctctgtgctgttctatctgccggtcaatattctggccaataaggtcggcaagaagaggctgctgctggttgccttcgtgatcttcacctgtgcgttcgcatttgccggcgcccttggttcggccgtgctcggcttcattccggcgatggcccagggtttggtgctctcggtggtcggcgcgattccgatggccgcgttcggcatcctgccgcaggccatcgtggcgaatatcgccgacgccagttccaagaccaccggccaggaccgtcagggcatgttctacgcggcccgcacctttgcgatgaagatgggccagtccgtggccatgctgctgttcaccggcgtctccaccatcggcatggcgtccggcgcgggctaccgcatcgccgccgtgtgcgcggccgtgctgtgcggtctgggcggcatcgtgttcgcgttctacaacgaaaagaaggtgctgggcgtgctggagacgtgatgacgttgccgggtgccgccgcggtatccatgcggagcggtgtgggtgacttgccccgtctgcgacaccgaaacgttaccgtgtcgacacgcgtgcgacacttcggcgtcaaattgcgtttgaccgtactccgtactatattgttgcgagttgctttgcggagcaaagtaacatccaaggggctgtagctcagttggtagagcgcttcgttcgcatcgaagaggtcgcggtttcgactaccgtcagctccacgagaccctctgcattcattccaccgcagagggtcttttcatttgttttcgttgaaattctgccatctctctcagcccctgcaaagggagaatgcctcgatttcgccatggattgtcgtggattgctctgtggcatgggcaatactgggagtatgacaagcgcagatgagttgaatgagcagtatgacgctgacggtagcgtgacgcaagtgcctgaacgcaatgatgaagttcatgccggcgaatccgccgtcgcccaatcccgcgaatcggccgtgaccatccccgccggcaccgtggtgctcgccgccaccccgatcggcaatgtcggcgacgcttcagcccgtctggtggccctcttggaacgggccgatatcgtggccgccgaagacacgcgccgcctctacgatctcgcccgtcgcctcggcgtctatgtgaacggtcgcgtcatcgcctatcacgaccacaacgagcgcgacaaggccgacggcctgctcgaccaggtcgaaaccggcgccaccgtgctcgtcgtatccgacgccggcatgcccaccatcaacgaccccggcttggccatcgtgcgccgtgccattgaacgcggtctgcccgtcacctgcgcgcccggcccctccgctgtgctcgacgcgctcgccctctccggcctgcccaccgaccgcttctgctacgaaggcttcctaccgcgaaagcattccgagcgcgtgcagtatctgcgcacgctgttgcccgaacgccgcaccatcgtgttctacgagacgcctcatcgcattgccgattcgatggacgatctgctggacgcgttcggcccgaatcgcccgatggccctgtgccgcgaactcaccaaggattatgagcagattcgtcgcggcccgattgacgagattcgccaaagtgtgattgatgatccgccccgtggcgagatggtgctggtcatcggcggcgcgtccaacgaggaggccgaagcggccgcgcccagcacgttgagcgtggatgacatggccgtgctctccatcgaccgtgctttggaggacggcctgcgtatcaaggacgccatcgcgcaagtggtgcaggagcatccactggctgacggatcgttggccaatcgcaagcaggtgtatgcggctgtgctgaaaatcaagggatagcgcagcagccggcgattatctccccgttacgcttccatcgactcgaacaatatttccaacgcctgccggaccccgggcccaccacgctgcgagaccaattccagcaaaggcgcgtcggctttgggattggcaaccagccatttacgcagttcgggcacgtgatatgcgatgtgccagagcacggcaacatccgtatcgggcgaacatgccaccgcgggcgtaagtctgatgggcggttcaggcggcgcggtcatatccgagattgcgcgcgatgcggattcggatgagtgtgccgccgccgcgtggcgaggcaaccgttgcgcctgccgcaaatgccgtaaacggtgagcggcatggcggcctctgcgatggcctctgacaatgaaccccctcgtcatgcgcattgctccaaagccggttcgtccatctcctgctgcaccgattcaaaaaacatgcgtgcgcgtccggcgtacttgtgatgccgatgctccttgacgatttgcagacagtcgtttggccgaaactggtacgcggacatcagctggcacaccagtgcgttgacggtggaaggatcggggatgtcttcaggactcatcaccaggtcgcaagccgtacgggctggcgtggtgacaggcagcccgccgagcttgatgatttgctccggcaacgtcaatcttttgaatacgcggatacggcggctgacggatgccgagcggaagtgcgatgtggaaatcacgtctatggtactcggaaagtcggggcctcccagccatacccaagcggcggtcatcgaacacaccacagtgccaaacggggcgacctccgcgacgattttcgcgcgaccatacagtgtgcccgaatgctcgatccagtagccggcggaatcgtcgagcttacgtaacgtgccgaaggcggccagacggttaaggctgagcggtcccggcagatccttggtaaacagtatcggcggcaccgcaggttgcgcggttgccggcgaggcgactgttgtgatgtccgtcatcggacctgctgtgatatccatgaccgaacaatatgcagaaatgcggcttgcgcgccaccggataggcgaaaacggtggataagtgcataactttactaggtgtgcaaatgatgtggataactcggtggatattggcaggcggaagtgtgtgcggatgtgcgtgggcgtgcgtacggatgggtgcgcggatacgtgtgcgaatgcgtatgtggataagcgcgcaagaggtgtacagataagtatgtggggaagttgcgggtggataggtgagtgggatgaggatggcggcgcggcagctatccgggcgtgtccccgccgcgccggataatcaagccttatgagtcatgttttggtgaatgttgcttggccgtatgcaaacggcccccgtcatatcggccacgtcgcgggatttggtgtgccctccgacgtctacgcgcgctacgagcgcatgaagggcaatgatgtgctcatggtgtccggcaccgacgagcacggcaccccgattctcgtcgaggcggagaaggaaggtctcactgcccaggaactggccaaccgttacaaccgcgtgatcgccaaggatctgtgcgacctcggcctgagctacgacctgttcacccgcaccaccaccggtaaccacgagcacgtggtgcaggagatgttcaagcagtgcttggagaacggctacatctacaagggcacccagcaggtggcgattagcccgtccaccggccgtaccctgcccgaccgctacatcgagggcgagtgcccgatttgccatgccgaaggtgcgcgtggcgaccagtgcgacgcctgcggcaacgagctcgacccggacgagctcatcaaccccgtctccaagattaacggcgaaaccccgcgcttcgagcagaccgagcactacttcctcgacctgccggcgctcgccgaagccaacaaggcgtggctggagacccgcaagggctggcgtaccaacgtcatcaacttctcgctcggcctgttcaaggaagttaagccgcgcgccatcacccgtgacatcgactggggtatcccggtgccggtgaaggactggattgacaacccgaacaagaagctgtacgtgtggttcgacgccgtgatcggctacctgtcggcttccatcgaatgggcccgccgtcagggcgacccggagaagtggcgcgaatggtggaacgacccgagctgcccggcctactacttcatgggaaaggacaacatcaccttccactcccagatctggccgtccgaaatgctggcgtacaacggcaagggctccaagggcggcgaaaccggcccgatgggtccgctcaacctgcctgagcaggtggtggccagcgagttcatgaccatggaaggcaagaagttcagctcctcccgcggcatcgtgatctacgtcaaggacatcctcgcccgctaccccgtggatgccgtgcgctactacatttccgtggccggccccgaatcctcggattccgacttcacgtgggccgagttcgtgcgccacaacaacgaggagctcgcctcctcgtggggcaacctggtgaaccgcgtgaccaacctcatcaacaagaacttcggcgagattccgccgctggacgaggattcgatgaccaacgaagaccgtggccttctggaagaggcttccgccgcgttcgacgtggtcggctcctccatcgaaacccaccaccagaagcacgccctgtccgaggcgatgcgtgtggtcggcgacatcaacaagtacatttccgccaccgaaccgtggaagattaaggacgaccaggctcgtctcggcaccgtgctgcacgtggccgctcaggccgtgtctgacgcgaaccacctgctcgcgccgttcctgccgcactccgcacagaaggtgtgggaggcgctcggcggcaccggcaccttctcgccgctgcctgagctcaaggaagtcgaggatctcgacaagcccggcttcacgtacccgatcatcaccggcgattacgagctcggtgtgaacgtgcacccgtggaagagcgaggcaatcgaggtcggcgccatggtgcctaagcccgcaccgatcttcgccaagattccgaccgaggccgtggaagaggagctggctcgcttcgatgaagcgttggctgctcgccgtgccgccgaagccgaacgtctggccgccgagaaggccaagctcgccgccgagtgattcggcattgctagctcgtagctgacgggccacctcgcacatgaagtgttgcggggtggcccgttgccgtatgtgcggcctagccccgacaatgcgaggccggttgtcgggcggcgttacaaacccgtcacagtttgccaagacttttctcagacaagcacatcgaatccccaagaaagagacggttatatagaagatgtcaacggaatgaagttcataccggtggcgaggttcttccgaaccccataactgaacccttcttctctcttctctctcacccggcggccccctccgccgggtttcttttttttaatgctgggaatgccatgggccgcatattgaaaaaaggattatggcagagtgttgtctgtttgcaataaggcattgctgttctagaaaataacaaagaaggggggactaatgatgtataccgtcacattttcgggcaacctgactcaagcggaatcggccttggtcaagcgaggcaccatacagatcgccgcgttgctggccgcaaaaatcactggccgcggactcatcatcaacgacggtgacaccgaatactcatgggatttcatcctggtcgatgccagcagcgatgagcggcacacctttgacgagaggctattgcggatgctgtccgactacatccacgccggtttccccgatgccgtgatccgccacgccaagcacgaggctccaaagctcggcaaataatattggtcgcgtggtgagtcccatacttccgtcggaatatcgctatcgcggtatggtcgcatgcctgttgagcattgaagcgctcgatctatgcgcagttgatgttccggtgatgacggcaaccgattgacgcgattaccgggacagatttcgctgtcccggttcgtgatttcggcttctttttgggaaccgggacagcccccttgtaaacgcccattatccgtaatcccaaaaccccggaattccgccgatgtacgatggcgaatattgcacggtggggtgataggtgaatgaaattttgtcttggttgctcaaaaaggggcgaaatggagaaccgggacagcgaaatctggcccggtccacacataaatcgattgacatcgctaccgggacatcggacacggacaccgagtcgcgcagcgtcggcgcaacatggatactgtacgactttcgcgataaacgttatattcttcgtcgcctccgccgggcgagctcatcgagtggcgttgccgtcaaagtgaaatcgaatacggcacctcgcaatgccaactgccgcccgacccggtaggcgagttcggcttgggatggctcatcggccatgttcgcggcagtggcgatgatgacgatccaatgatgatgtcgcagcagttcgcgcttgtcgttgtcccgccgccactggtttttgtcggtgcgatgatgatcgccgtcatattcgatggcgacgcgaaattcgggccaagcgagatcgagcgttatcggcgcaccgttgctgaatgtcgcgccgggcaccgtgtaatttgtcacggctggcggaagcccgtatttcgtcgtcgcgatgcgggtctttgattccatcggagagtccacgcggggcgtaatgaatgcaagagcgatcatgcacttggattttgcgttgaatttcgggagttcggtgacttgccgcacgaagtcctgataaatgccgtcagcagtgcggccgttcgccagacccggcttgcgggcgattgccgtaaggattgcgtcgccaagtatgaccagcgattcgagcgatatatgagcggcgagttgtgcccaagtgtgtatcagatccagtgcgtacacatgtttgttgatacgcacattgtgcgcatcgctcagcggcttccagatgtgtggtgtcgttggcggcacgatggcacgtattcgtgtgcggtgtgagtcggagacggtatggagctcggcggggtcgatatcgcaatccttgggaagcggcacggattgcagtatcagcgatgtggtcatgccgaagagtaccggttgcccgagctgttgcgcggcgtccgtgcatcgtttaagcatttcccgcttacgttgggtgagggtttcgctcattgctggcgacacagggcctgtaatcacagttggcgcggaactcgccatacgtggtgatgaacgtagctcaggattgatggtgcgcgcagacgcaacgcccggtgtgtggggccgggtccagccggacggttcgtcgtcgaatacgccgggcggtggagtgggcaatatgtcgttcatgacgccaccgtagcgcagcggtcacatgctcgctatgaaaaccggggtatgtggctctagcttgcgggagatgtggataactctgtggataactagttcggaacaattagcgaggccggaacctaccggcaattggccgatgatgacggcacttttgctcagctcagccgcgatagtctcgaataggtgcggccgggcgtactcgcataacgtaatgccccttctctctgaacagagagaaggggcattcgaatatatgctcccgccagcggaacgtcagcggcagcggcgggtgaggggctgccagggatcgagctcgactggttcggtggtgagcagggcgcgggtggcgtcgtcgaggtattccttgcggatgatgagctcggtaacgtagcggtcgaaccaggcgtcggacatgacgtagtagccgtccttgccggcgtccttgccccagctgttctccaccttccagcggttcggcttgccgtcctcgtcgaggttcacgccggtgaaggtcatagcgtggttgctcgggctgtcgccgtattcgaggccgtgggccttgtcgccggtgaattcggtgccgaacagctggtcgacgcgcaccacggactggtcgaagaaaccgtccttgcgcagggcgaactgcgtgcagtcgcaggcgaaccagatcgggtggccggcggtgagctggtcaagcgcggccttcttgaacacgtccagcggcacgttgacgaattccatatcgccagcctcggccacgttcgcgctgaagcggatgtggtagcgctggttgaacgggcggttcttgagcggggcgttggccagcgtcacgaaatcgttgacgtccaccggcacgtacttcttgtaaaactcaagcggggtgatgccgatctcgcgaatctgcgggcgctcgtccttgccggttttcggcttgtcggacttgtccttatcgcacttgcaggccttggcgtcggatttgccctcgcacttgcaggattcggccttgccgtctgcgtcggcctcggccttgcacttgcgagcctcgcccttcttatcctcatcatcatccttggggcgcgcgaagaagtcgaacttctccggcggttcgccgagcgccacggcgcagatgcggtacacggtgcccatgtactcgtccttcaacgcacgcagctcgtcctcagacgcccccgcaaccgaacggcggcgcagctcggccgcgaactcgcgcagcttggagttgaggtactgcttgaaatcgtcggaattacgggagttctcagactccgggtaggcgctcttgggcactaggccgtacttgttcaccagtgcagcgaacatctgccaccagccaccatcgtctgcaggcgactcattgatggcctcgaacagacgcgaatcggtcgcctcgtcgagcgtgcgcagcacgttctccagataagtgttcgacttctccatcgcgtcccagaagaacaggtaggtctcggagaactcgaaatcctcaagattccagcgatgcatgagttcgtaacgcagcgtgttcagggaggcgaacatccagcaacggccggaacgctcctgattggtgatcgaaccctgcttgagttcgatggagaagtcgcgcggcagcgcacgcacgccgcgatagtcggtggccgccttgagcacgccggccgaaaccgccgcgtccgccgcgatcaggttggcgcggtccttgttgaagtcttcggtgtacgtacgcagaagttcgggtttgatggcccgtgcgctggcgtttgctgtcatgatgattgatcttccattcatgtaggcgacgtttgtggtccgtcggtagtataagtcgccgtgtattcgtcggacgattcaccgggcgaaatcgtacgggcggatatgcgccggcgattccaccccgccaacgatttgtccaccttgctgctcgcgcgggcgcacgtatcatatgtaccgatacatgttgttgacgaatgtcgcatagtccaaaggagtacgtcatgacttcgctgcatagcaagccgctggccctgaaaaacgtcaccgtcaccgattcattctggcgcaccgagcaggaactcgtgcgcacggctgtgattccctatcagtggaacgccctgaacgataacgtccccggcgcggcccccagctattgcatgcacaacttcaaggccgctgccgcgcaaaacaagcgcaaggatacccagggcaacgcgttcgtgccgccgaagtacacgttccgcggatttgaggcgctccccgaagacccggccaatcccgacccagacaagttctacggcttcgtgttccaagacaccgacttctccaagtgggtggaggcagtcggctattccctcgcccatcacccggaccccgcactggaacagaccgccgaccaagccatcgacgtcgtgtgtgccgcccaactcgacaacggctatctggacgcctactacatcctgaacggcatggatcgcgcgttcaccaatctgcgtgaccatcacgaactgtactgcctcggccacctcgttgaaggtgcggtggcctactaccagggcaccggcaaagacaagttgctcaaggccgcctgccgtttcgccgattacgtagacgagcgcttcggtcgcaagccgggccagctgcgtggttaccccggtcacgagattgccgagatggctttggtgaggctgtacgaggtcaccggcgaacagcggtaccttgatctggccgaatatttcgtgaccgagcgaggccggcagccgtacatcttcgatattcaggcagacgagaacgcaaagcgcgacgccgacgccaactacaaacccaacacggaccccaaccggtacgcctaccaccaggcgaacaagccggccaccgaacaagacgaagccgtaggccatgccgtgcgcgccggctacttctactccggtctggcggacgtggcccgactgaccgacgaccaggacctcgccgatgcggccgagcggctctggcgcaatatcgtcgataagaaactgtacgttaccggcggcatcggcggcacggtggacggcgaggcattctcctacaactacgacctgcccaacgactccgcctactccgagacctgcgccgcgatttcgctggcgttcttcgcccgtcgcatgctcgagctcgcgccaaaggccgagtacgcggacgttatggagtcggcgctgtacaacaccacgctggccggcatggcgctggacggcaagagcttcttctacgtgaacccgctggaagtcaatccgtatgcctgccataaagacagccgcctgcgccacgtcaagccggtgcgtcagaagtggttcggctgcgcatgctgcccgccgaacatcgcccgcatcgttgagtcggtgcaggaatatgcctacacggttgccgaggatggcggtacgctgttcacgcacttgtatatgggcggcgtggccaaagctgagttgaatggtacggctgtggagctggatgttacggcgaacctgccgtggcaaggcgatggcaaggcggtcgtgcgcttgggcggtgacgctgctggcacctcggctcaggctcctgctcgctttacgctggccttccgtctgcccggttgggtgggcgatgagtccgctgctgccgccgcgattacggccacgggcgagtctgagtctggggccgatagttcccgcgtgacccgcgaaattcgcgacggctacctgtatctgaccggtgagtggcgcgacggcgacaccgtgacgttcgacttcccgatgccggtgcgtatgctggccgccaacccgctggtgcgcgaggacgccggcaaggtggcgttcgtgcgcggcccgatcaccttctgcgccgaggaaaaagacaacggcgccaacctgcacctgctgcacgcggatgtggaggcactgctggccgacccgagcgcggccaaggtcgaggagttcgacttccacgccggtgctactggcatcgatgagcagggacaaggtgaggtggaagatgtgacccgccgcatggtgaagcttgaggtgccggcttggcgcgagccgttgccggctgctgtggccgccgcgggtgagggcgcggccgaggttccggcgttcgcaccgctctacaccgcctatgcgccggtcaagcgcgagcccgtcaccgccacgctcatcccgtacttcgcctgggccaaccgcggcgaaaacgaaatgaccgtctggctgcgcggctgatatttgctctcgtctactctggtagccatgggcatcacgacatgtcggctcgaagggccggtggacttttactcggtcgggcagtttgtgtccggaccgggctggcgccatctgcggcgcaccatcgacaccttcgagctgatgttcgtgcgtcggggcgtcctgccgatgcgggtgggggagcagaccctgcatatcgaggccggccaaatcgcactcttgccgccgaatgtggagcatgcgggcgccgacatcatcacgtctgacgtggacttctactggatgcatttcaaattgccggatgcgcgcatgctccccgatgacgcgggtctgccgcaggacgaccattgcctgttgctgcccgatgaacgcaccctgcccgaccccgaccggctggcggtgatgtgtgggcagctcatcgacatctatgcgcgattcggcccgtattccaacgcttactgcgattacttcgccaccggcctgctgctggaggtcagcgcgcaggagcggctgaaggcggactttgccgcccatcgtacgcttgccggctaccggggcgacggcaagcccatcaccagtgccgaccgcgtccggcagcaacaggaatgggccatgcatgtcgattcggccggtgccgctggcgattcgtccggcctggcgccgatgctggccatccgctcgtggattatggccaatgccttcgacgacatcaccgtggccaaagtggccgcgcgcttccactattcacccagctatctgaccgcgatgtaccggcgcgtgttcggcgtgggtgtggccgagcagatcatcgaatatcgcatcgaccgtgcgcgcgaactgctgagttctaccgcttccagcgtggcggatattgcgcgagaagtgggctacgccgatcccaagtacttcatgcgcgtcttcaagcgccgcactggcctgacccccggccaataccgcgacgctttccccgcccgcctctacaacaccgtgtgattagggaaggtcatggtcctaaccctaggaaaagtgcgcatgggtgccactaccacgtgggagcgctgggaacggtttgacgcatgccgaaacctcgcacgtcacgccgcacggcacttgggcagtgggcgcggcagtcgggaatcgccgccctatttcggcgtttcagcgttacctgtttgccgaaccgacagtggactcgcgcggaaccagtgtgtatccaatggtggcgcgcgtggccggcatgccagcggattcgtcggacctgccgtcgccctggtcgcgctgctccacgcggcgggtgatcatatcaagcgcgaattgggcgagctgatcgagatccacttggacggtgctcagcgtcggtgtggtgtacgagccggccgtggcgccgtcgaagccgatgactctcacatcgtcgggcacgcggatgccgtagtcggcaaggcctcggattactccgaatgcggcatagtcgttaatgcagaagatgccatcgatggccggggtgcttcccgttgcccgcgtggtgcccggggaacgggactcagcagtgtcatcagccgattgcgcacgagcctcgagcatcgcctcggcgatggcatgaccggcttcgatgccgctgtcgctaccgtaaccaatgaagttcgtcgattcgtcatacggcagcccggcatcgagcaacgcgccgctggccccgcgcaggcgcaaaccgctggaactttccacgtgcgccagttcggttcgtggcgaatacccgtcgccgacgatggcgatgcggtggcatccgcattcgatgagatgctgcactgccgcccgcgcaccgtcctcgttcgggaaattcactgtatcgaacgtgggcgtttcctcgcaggcgtcaatcagaaccagcggtcggccgtggttgatcgcggaaagcggcacaccggcattcaggcccgaagcgtggataatctcgccgtcgaacaactgcccggagaacgggttgttggccagcgcgtgtttggcggcatccggagagtaccgggtttgctccacgaacggcgtcagcccgcgctcggtggtttcggtgacgagcgattcgacgagtttggagtagaacggcgaatcgaattcgttgacgatgatgtggatgatgttgctgcggccggacttcagcatgctggccgtcagattgatgcggtaatcaagcttttcggccactgccagcactttggcgcgcgtggaatccttaacacccggcttgccgtgcagcgcattcgaggcggtcatgggggagaccccggcggctttcgctacgtcgcgcaatgttggtttgccgctcggcataacgtcacctcatgtttcgcctgtgatgggcattggatcatgcccgtaatgcttccaatggttgtaacggtattcacaacatcgtgttttggcaaatggtggctgtgtgccggaatcgctgaaaatgctgcgcttaggcgatgacgcgccgagcgtaacatgcgcttgcttgatatcgttccggtggaagaatatgtaacggtacatacgtcggtgtgccaagaggccatgaagttcgtcgtacgttgggatgggactctccgggggagtggcgtcactcttcacctatccgtacgtgcgcgatgccgattggtttgcggctggcgtaccgccgtatggcaacttatacgaatatcaacgaaagcaggatacgatgacggatcttccgcagagccttcctcaggcatggcgtccgccgatgggctggaacagctgggattcgtacggcacgactctcaccgaagacgagctgctggccaacgcgcggttcatggctgaacacctgaaaaacgccggctgggatacgttggtcatcgacatcgactggtacgacccgaccgcccgcgcacatggttacaacgacaacgcgccgctgattctcgacgaatacggccgccagctgcctgacccggtgcgtttcccgagtgctgccggcggcaagggattcggcctgctcgccgccgccgtccacgaactgggcttgaagcttggcatgcacatgatgcgcggcatcccgcgtatcgctgtggacaagaacctgcccgtatacggcaccaactacaccgccaaggacgtggccgacctcgaccacgtgtgcaagtggaatccggacaactacggcctgaaccaatcccacccgggcgcgcaggcctggtatgacgcgcagctcgacctgttcgcctcctggggcctcgacttcctcaaggtcgacgacatgcagaccccgttccactccgacgaaatcgccgcctatcatcgcgccatcgccaaagccgaagccaaatacggccgttcgattgacctgtctctctcgcccggcggctgggtggcgacgagctacgtcgacttcctgcgcgagaacgcccaaatgtggcgtatttccgacgatctgtgggaccgttgggaagacatctaccagcagttcgcccgcttggcccgctgggcgccgttccagaccaccggccactgggccgacgccgacatggtgccgttcgggcacataggcctgcgcgccgaacgcggcgacgaccgccaatcccgccttacgctggacgagcagaagacactgctggccctatggtgcatggggcgtagcccgcttatggtcggcggcgatctgcccaccagcaacagcgacgccatcgcgctgctgcagaatcccgcgttgcgtgaggtgcttgccggctccaccaataaccgcgagaccgtgcgcgaacggatttttggcaaatggtgggatgagagcacctaccgtggcgagttcatcgtctggtccgccgacgcagccgattgggccgatggcacacgttccgcgcatcacggcggccattacgccgcgctgttctggaccggcagcgacacatacgagatcggccgcaacatccagctccaatccatcgtggggcttgacgcccgcaatgacgattggacactcgccgatctgtatgccgacgcgccgggcgagcccgccgacgtgcgtcttgaaggcgtgggtgccgaccgcgtcatcaccggcacgattccgccgcacggcgtgctctgggtggtcctggaccgacgctgaaaccgaacctgcctccgccaaccaacctcctgaaccgaccgcccgaatcgtatggagaaacctgccatgaatgcgaacatcgcaaacgaacaatccccggtagctgttccgcccgcaagttggttcctacgtgcgttcgctggcgttctgacctgtaggctgtctgtctctgtctgttcgttgtcttcgccttgcttgcgttttgtacgttttatctgtttcgtgagtttcgtgcgttctgcggatttcacgcgtttcgcgcagcgccgcacgctgatcacaattcagcgtgcggcacttttgcatatctcacgtgttgcgggagatgccgattccgtcgcacaatacgtaaaacgtgaatgagccactcactatgctgggttgtttgagcgtgatatgacatgcgccactttcccgggaatgcgttgcgaattggacctgttcggaggtgtgcagcgacgcattccggggaatgttgcgcttagagagccgcgtatcgttgctaatgcggggaacacgcagagttgcgggccgttgcgattagacgcaggctgtctagactagtacgcgtttgcgaaagtcgaacgtgcttcgaccgatgaaggagagcttcggtcatgcggccaatgacaggcgcagtgcgaagcacggctgatcgtgaatcgcggcggcagcgattgccgcgtgcggcgcaggagcatgccgcaccataccacaagcaaacaatccccaagaaacggtgatctcctcacatgtacgtcgatccgggaatcaataccagcgcaagcaatctcaaatgggtgctgccatactgcaaaccagacctgccccgcgtggtaggcgcgcttctactgttcatcgcaaataacacgatggccctgaccattccgattctgtccggtatcatcgtggaccgcgtcatcgtcggcggacatgccgacgaactgccacgtttgtgtggactgatgatcctcatgaccatcatccgcgtgggcgcgcgatacggctaccagatgtggatggagcgtttcggccagaactcggtctaccgcctcgtctccgacgaatacgagaagctgcacgagctcgacttcacgtatttcaaccacacacgcaccggcgacatcatgagccgcctgacctccgacaccgacgcgatccgccactgcctgagttgggtgagctatcagattgccgactgcgtggtcatgttcgtgggcgccctgtgcgtgatgttcgccatcgattggcgactcgcgctcgtcctggcctgcgtcacgccgttcatttttgtgctcacgcgcggcctgtccacgcacgcccacccgctgttcttcgccatccgcaactcgctggcctccctcaactccatggtcgaagagaacatcgagggcaaccgtgtggtcaaggcattcgtgcgcgaaccgtacgagaccgaaaagttcgacgagcacaacgacgattacatgcagtgcaacatggccttggcctacaactcgcgcaagtacatgccgtggctggacggcctcggtttctcgctgcagctcatcaccctcggcctcggcggctttctggtcatcaagggctacatgaccctcggcaatctggtgagtttcaactccttcctgtggatgatcgacggcccggtgcgccagtccggctggctgatcaacgactggcagcgattcaacgccagctgcatcaaaatccgcaagctgctcaccgaacagccgcgcatcgtggagaagcccgacgcggtcgaagccgtcaagcaggcggtcacgatcgtcgagcaagtcaagcacgatgatgaggctaccggggctaccggagcgcccgtggcttccggaacatccggtgcccagcagtccaccgaacgcaagtcctgcccgctgcacatcaagggcgacatccgcttcgaccacgtcagcttcgccttcccggacgacccggagaccccgatcctcaaggacctcgacttcaccgtgcccgccggctccaagctcggcatcctcggcgaaaccggcgcgggcaagtccacgctcgtcagcctcatctcccgcttctacgacccgaccgttggccatgtgctcatcgacggcatcgacgcacgcgactggccgctggccaccttgcgctcgcaggtgtgcatcgtggcgcaggataccttcctgttctccgacaccatcggcggcaacatcggttttggtgccagcggtgatagcgacgaccgatatatccagaaaatggcccagatcgccggcgcggacaatttcatcaggtcgatgccacagggttatgacaccgtcgtgggcgaacgcggcgtgggcctgtccggcgggcagaagcagcgcctgtcgctggcccgcgcgctcgcggacaatccgtcgatcctgattatggacgatacgacctcggccgtcgatatggagaccgaggcggagatccagaagcacctcaaggagatggacggcggcaagaccatcgtcgccatcgcccaccgcatctcgtcggtcaaggattccgacctgattctggtgctcgagcacggacgtatcgtcgaacgcggcacccacgccgaactcgtggccgcacacggccgctactgggacatctaccacaagcagctcggactccagtccggcgtcgcacaaggtttttagaagaggacttatggcacaacgcaatacataccgcgaggatgaggaactcgaggagcagatcaacttccgggacatcctgcgcgtcggcaaatatctcaaaccgtatatggcacaggtggcgcgcattctcgtcgtcgtcatctcgatgagctgcatcgtcgtcgccgtgccgtacctgaccaagatcatgatcgacgaggcgatcccgaacaaggacctcggcaagctcggcatcctcgccgtgatcctcgccgcgctgatcgtgctgtacgagttcgggctgcgctaccgcacggtggcgatcacgcgcgtcggccagctcatgctcaaggacatgcgccgcgatatcttcacgcatatccagacgctgcccttcagctacttcgattcgcgcccgcacggcaagatcctgatccgcgtggtcaactatgtgaacacgctttcggacacgctgagctccggtctgatcaacgtgatctccgacgtgttcaccttcgtgatcacgctgatcgtgatgttcgtgatcgactggcagctggccctgtggagcctgatcctgttcccggtgctcatcatctgggtgcgcgtgctgcagatcttccagcggcgcgccttccagaagctctccaacaagcagagcaacctgaacgcctacatccacgagtcgatcgccggcgtgaagaccacgcagaccttcgcacaggagcaggcccagttcaggaccttccaggaacagcagggcgaggtgcgttccgcgtggatgcacgccgtgcacatccagttcctcatgtggccgggcgtgcagaccatctccgtgatgaccatctcgttcatctacttcgtcggcgtgatgggcttcgggggcgtgaacgtgaccaccggcgtgctcatcgcgttcgtcggctacgcgaacaacttctggaatccggtgatcaacatcggcaacttctacaaccagctcatcacctgctcggcgtacctcgagcgcatcttcgagacgctcgacgtcacgccggagatccgcaacaagcccgacgcggcggacctgccgcagatccgcgggcgcgtcgacttcaacgacgtggtgttccgctacgagaaggacggccgcaacatcctcaacctcgtggacttccacgtcgaaccggggcgcacaatcgcgctggtcggcccgacgggcgccggcaagacgacgatcatcaacctgctgtcgcgcttctacgacgtgtccgagggctcggtgacgatcgacggctacgacgtgcgcgacgtgacgctcgcatcgctgcgccggcagatgggcgtgatgctgcaggacaccttcatcttctccggcaacgtgcgcgagaacatccgctacggcaagctcgacgccaccgacgaggaaatcgaggcggcggcgaaggccgtgcacgcgcacgagttcatcatggaactgcccgacgggtacgacacggtggtggaggagcgcggatcgaccctgtcggccggccagcgccagctcatcgccttcgcgcgcgtgctgctcgccgacccgcgtatcctgatcctggacgaggcgacgagcaacatcgacacgcgcaccgaggaggcgctgcaggccggcctgcagcatctgctcaaggggcgcacgagcttcatcatcgcgcaccgcctgtcgacgatcgagaacgcggacgagatcttctacatcgatcacggccagatcgtcgagcacggctcgcacgcgcagctgctcgccgccaagggcgcgtactaccgcctctacgagtcgcagtacgcgatgattcgcgtggccagcggggcgccggaagagtgacgagatgttgcgcacaaggatgcgtttagcggcgtttcacatagcgggtgctgcgaccggcaccgattttgatgatcgtaccggagtccaacagtgatttcagcgtgcgctcaatggtggtggtgctggtatcgggcatgcgagcgagaatatcggccttggagagtggaactagggattgatcaagcagtgcttcaatccgcgttcccttggtggctactcgcggtgctccctgcgctctgccgcctgccgtgagattgatgcgttcgtcgaattccttgcacgcggacagtatgatgccaagcaggtagttcgtgaatggcgcataatcattggcgttgtcgtcccagccttgggtgcttgcggccagcgcctcataataagtgcttttactttgctcgataaggtgttcgatactgatgtatttgccgaccatatagccattgcggcacagcatcaggagcgtgagtagccgactcatacggccattgccgtcattgaacggatgtatgcaggtgaaatcgagaatgaacatggcgatggcaagcaatggatcggtatgtccatctcggattgcttgcgtgtaggcggaacacgcgcgttcgatcagtattcgatgtagtcgaatgatctcataccgcctcattttctgcatcatacgaacttttctgcatcatattttatcaagatgaggcagaaaatgggctgatgaggcagaaaaggcggcaggatggcggccatctcgcttgacgattgcgcgattcttggcgcggtgctgctcggctggttcgcctgtgcgatgatcgtctgctggattatttccgctcacctgagtatcgataagcgcactgattccatcgttcttgctgaaatcacccgtttgcgcaacggtggtgccaaggcggacgtgaccgacgatacccgtcgtgtagtcgaacgtcttaccggactgccttacgagcgttgctgacggtagcctacactgagaaacagcttacactgagaaaccatgagcaagcaccaccatcgcgaccgtagctgggccccggcacctgaagcattgccggacgacgcccagaccatcgacaaccacactcacgtggcctccgtaatccctttcgcgcgcgctatgagccatgaggcgcaggagaaggggcagcccgaagtcccggtgtacgacgtcgaccaattgctggcgcaggcgcaatctgtcggcattgggggtatcatcgactgcggttgcgagctgccgcacctgatgaccgccgtccagatggccctcgatcatccaggtaacgtgcacgcggcgctcgcaatacaccccaatgagtccgtgctccacgggcatcgcggtgtgccggggccggatggtctgcctctcaaatacaagccttaccatgacacgtctttcgaggacgcgctcgccgaagtacatcgcctcgccaccacataccccgagcaagtggtggctatcggcgagaccggcatggacctcttccgcaccggcgaaggtgccaaggaactgcagcgcgaggctttccgcgcgcatatcgccctggccaaggaactgggcctgcccatgcagattcacgaccgcgactcccatcgcgaggtcatcgaaaccctgctggccgacggcgcgcccgaacgcaccgtattccactcgtattccggcgaccgtgagatggccgagatcgcgcgcgaacatggctggtatctgagcttctccggcaccgtgagctacaaaggcaatgacggtatccgcgaatcgctgcggattgtggggctgggccatgcgatggtcgaaaccgacgcgccgtatctgacgcccatgccgtatcgtggccgcaccaacgcgccgtacatgattccctacaccttgcgggccatggccgatacgctcgacttgcccatcgcggatgtggcgcgcggcacccgcgataccgcccgcgccgtatacggactgtgagggccgggtgtgcggccgtcgcggcgcgtgtagagacgatgtgttgacttgtaaaatttgtcagaattgtgaacgaggtctatcatgatgtgtttgacataagcgagggggatgatctccacctcaatggaggactgaacgtatggctgagtcgaaccaaaggaccgcacgcgcccaaaaagccttaaaggcccagaaagcccagtctggcgccgccaaagccaaggcccgacaggaagaagaagcactgctgagggccgacacctttaccaacgctcccaaggtgtcccgccgcactctcaccaaggaggagcgcgaggcactcgccaagcagagggaagctgaaaccaaggaagccgagaaaatcgccagcgcatggtcgaaaggcggcctcggtcgatggtgggcccgcctgcaatccagcccagacaaggtcacctggggcatggcaatcgtggcgctcggcgtggtgtacggcgacatcggcacctcgcccttgtacaccgcgcagaccttccttgccggtcagggagggcttggcggcgtagaccgagaggccgtgctcggcatgctgtcgctggtcttctggtcgattacgctgatcactaccgtcaaatatgtgctcatcgccatgcgcatcgacaacaatggcgaaggcggcatcttcgcactgtactcgttgattcgcaagtacggcgcatggctcgcgattcccgccatgctcggcggcgcggcattcctcgcggattcggtacttaccccggcggtttccatcagttccgcagtcgaaggcttgcagaccctgccgccattggaagggttgttcgacgaaaacccaagcctgaccctgatgatcaccgtcgtgatcatcgtgattctcttctccgtgcagtcgcgcggcaccgaaagcatcggcaaagtattcggctcgatggtgctggtctggttcggcttcctcgccatcgtgggcgtcacgaatctctctaacgactggtctgtgtttgaggccctgaacccggtgtacggcatcaaattcctgttcagcccgcacaatgctgccggcatcgcccttatgggcaccgtgttcctctcgaccaccggtgccgaggcgctgtactccgacatgggccacgtggggcgcggcaacatctacttcacctggccattcatcaaggttgcgctggtgctcaactacttcggccaaggcgcgtggatgctggccaatagcgataacccgcaatacactgcgacggagtcactcaacccgttcttccagatgatgtctccgaacgtacgttatctggccgtgattctgtctgtttcggccggcgtgatcgcttcccaggccctgattaccggcgcgttcaccatggtctccgaagccacccgcctcaattggatgcctcatctgcaggtgcggtacccggcccgcacgcgtggccagctgtacattccggtggtcaacggcgtgctgtgcgtctccacgctggccgtactcgccatcttcaaggattcggaacacatctctgccgcatatggactggcgttgaccattacgatgatcaccaccaccgtgttgctcggcgtccacctatggcattccggcaagcgggtcggtgccatcgtgttcaccgtgctgttcttggcgattcaggctatgttcttcatcgcgtctatggccaaattcctgcatggtggttggttcaccatgttgctgaccgccgcgattctgttcgtcatgtacacgtggaatgagggcaccaagctcgaacgtgcgcaacgccgtcacatgcggcccaacgacttcctacccgcgctcgacaagctgcacagtgatttccgcatcccgtattttgcggacaacatcgtgtacctgacctccgactcggaaaccaagcgactcgacacggacatcttcttctccatcttcgccgaccaccccaagcgcgcccgtgcttggtgggcagtcagcgtggaaaccaccgacgagccgttcacccgtgaatactcggtggaggacttcggcacgaactacatctaccgcgtgcgcttccgtctgggattcaaggtttcgcagtccatcccggcgtacatccaccagatcatgcacgacctgtccaaaaccggcgaactgcctaagcagaagtcgatttaccccaaggtcgacgccgatccggacatcggcaccatccgttacgtgctgattcacaaggccctgatgccggaatccaaggtttctgcacgcggtgccctgtcgttgcaagccaagtacgcaatccgccacatggccggctcgccggttaagtggttcggtctggcaccttacaacccgttggtcgaggtgcagccgctgttcgtctccacccgccgcccaccgcgtctgaagcgcaccgatacggccaagaccatcccgacgcccacgccgactcgtgcagtggccgacccggccgccgtccctgacccgatggacaccacgtccgggcttgggcgattggtacaggagctcgatgccgccgtatcggccgaggcgcggaagaccgctgaggccgctgccgccgatgcgcccgctgagcagggcgataagggcgataagggcaaggccgagaacggcaaacccgccgccaagcctcagcgctccgccaaacagaagcgataacataccagtttgcagcggcgctgatgcgctctataaagaatgcctataacggtcgccgcacgtcgccacacggtttcggtaagttgaaataccatgtgcagattactgggatacgcgacggcaggcttcaacctgagtctcaacgctgtgttggggcaagacaatgtcgaggatttccgtgaactgtctgaaatccacaatgatggctggggtgtagcccagctttccgatcctgccgaagcaccgcacgtgcgcgacggtggcgcacccaccccggaaaccggcacccgaatctacaagtcgaccatcgcggcccgtcatgacagcacgtttgaggcgctggccgacgaaccgtctcgcggtgccatctggcacctgcgcttggcaagttccaatctgccgctcatcatggagaaccagcacccgttctatgcgaacggcctgagcttcatccacaacggcgatatctcggacgccaatggccgcaacatcgtcaccaaccgctcatacccggtgaaccacagcgtgttcctctccaccggcggccgttccgactccgccatcttcttcgcggtgattctggaatacatcggcttcggcttctcgctcgacgaggccgtggcccaggccgtgcgcgaactgcgccaagcctacccgaagtccagctacaactgcatgattcagtccgaggaccagctcatcgccctgtgcgccgccggtcgtgagaagaccagcccgcgcatcgtggaaatctacgatgagtacggccgtggcgagcaggccgccgactaccgtgtgatgcgctaccgtgagctgcgcgacgacaacggcgactccgccggtgtggtggtctcctcttccggctacaagcaggaaggctggaacgtgctggagaacgaccagatgatcatcgtctccaaccgcaacggcacctaccgtctccgttccatctgaaataccttcataagccccctctgacgagggggctgtcagccgacaggctgacttggggggagacccctagagcctcaaatcatccgcatcccatacttctccgccaacgccggaatatccggcacgccatacttggctaccagatccagccatcgctgtttgttctctccgccaaatcgctcggctcgggccgtatacgcctcgacctgcaggaacttcggcggcactgacttgctatggaacttgtcggcgtacatcaccacttcctgctcgagattcatcggcacatagtcggctggtggcaacggcagctcctggcgcaccacatcctcgcgcgtaagtcccacgccggtatggttgcggcagaactgggcgatggactcgtccacgccctcgtcgagcagatactcgtagcccttaagaccgtgcagaatgtagcgtttcttgctgaatttgagcggttcgccgtcagagccgtcatgcttgaacacgcggtaggtgccgatgtcatgcagcagtccgccgatgagtaccaaatgctcgtcgagcagacgcggcggcacatggccgccggtgacgcctgtggtgggcggtacctccgcgtccttcggtaatgtgcagcggcgcgtgaacagcgcgttctgccggcgcacgatctggcagccgatggtcgctacaatcacgcaatgcgtgtgcaccagctcgtacgccgccttggacggcgcgattttgcggtgcaattcgtcgatctgctccagtgtgggaatatatccggtcataattatcaggtttcgcctcgtacggtcagatttatcctcagattagcgcggcaatgagccgcagcattgaaaaacccctgcgattcggcaatacgaatcacagggggctctatggtctgaacatcagatttcgaagagtgtgtcggctgcttcggcgatctcgcgcgacgcagtgagcacgataacgcagtgcttcgggtcaccggtgtgcgccagcttggccagcgcggcgaacacggtcacctcgtcatccgcgttcagccctcgtgtcggctcgtcgaggatcagcacctcggcctcggtgctgattgcacgggcgatggccaccaaacgctgctgcaccaaaggcaatgtgccgacagccacgccgctggtggcctcagagaagccgaccttggccagcagttcgcgggcgattaccggcttgggcttcaggaagttgcggttggacgcattcatggcgtacagcacgttttgttcggcgtcgatcttcggctgcacggcgtgcagctgcggtacgatgcccagacggtggccgcgcagttccacgggctcgagctcaacaatgttggcgctcttgttcatcaccgtgccagacgccggcgtggtcaaaccgctcatcacgcccatcagcgcgcgacgcttggcgtcggcggtgatgcccgaatcggggtcgtcgctgatcagcagcgcgtatgcgtgtccggaatagcagaagaaattcgcgccatcgaggatgttgaccttgcccttgggtccggcgaccgtcaccttgttcagggcgaaggtcgggtaggtcttgagcagaatgtcgtcggaaccgccgcccaccaacacgcgatcgatacgtgaggccagcgtcatggtgggttcggacgctttgccctgaggctccgcatgctcggccaatgcgtctttgtgatcggttttggccagtcggagtgtttcgttgacgcgggcggcattgcgctcggtcacttcggcggatgcgttggccgaagcgatggcgtctgcttcggcctcgctggtctcgtcggtttctccggtttcggcagatgccagtgcgctgtaaataccatcgtcaacagtgccttcgtcatcaacgtcatcgaaggtcacgctgaactgcatggagtcagctggaacggattcaatggcgtcgttcgtctcagtctcagaagtcgcttcgtcagccgttgcgtcagtggtcttctcgagttcctgatcgttgttcctgtcgctcatgcctgtgcctccgcatcgtcggttgtggtggtcgtcttgttggtctcgctcacggtgccccagtcgccatcggcggcaaacagcttgttcgcgctgaagaacgcaaggcgcagggcggcaagaatcgccaggatcaggattgaacccagtccataccagaccatggtccaaatcaggcccgatgtcaccggggtggcatggccggatgccagggcagatccgatcggattggcggcgaacgcgcctccgaccagaccaatcacgtagaagggcagggtgacgatgaacacttccagcatgaactgccatcccaaacgcccgcgagtgacgccggacaccagtgccatgccgatctcgtcgtcacgcttggacgcccacacgcccgacagcacgaggatgagcaacagcacgccgcccacggcaaccaacacaatggtgccggtcttcgcgcgcgaggatagcgtatccagcggctccagagaagcgttgtaggattccagcgaaggggaagagaactcgtaacccttggcgggcagcttggacttcttgagggtggataccaaggacttgtatgtagcggaatcaccggcgtcgaacaccacgtccagatccgggactgcccagccggagacggtcttgtcggtggactgtgggtcgagtccggccttggcgaaggtctgatagttggtgaagatcgcgttctcgcggttgcgggcggccgtcaccggattggcgacggcggattcggatgtgtacttgtagatgccgcgcaccttgagtttggccgtggtcttggcgtccgaggcggccgccacctcgagcgtatcgcccaccttcaggttgttggcggaggcaaacgcttcagagaccagtgcgccggtggtgttcgggttggaggactggttgttgtagctcaggtccttgccgtccacgatttcgaaggtgccgaggtcgctggccttggcggaatccttggtccagaaggctcgccaaatgagctggccgccggtctcgtcatcggaggccgagcccagcgatccgccgtccagggccttcaaatcaccgctcacgcgggccggcacggtttcggtaaccgtgaagttcaacgagttggtggccgactggacgagcgtggcgtattcggtgtatgaggtccacgtcatgtaatgcttggtggaagccgagtccgtagcggagaccttcttccacgtagccgcagtcgggcgaatggccaacgtggccttctgctgatcgtacgcggtggtgtgtgcgttggtatcttcttgaatgatggccagtccggcgactgtgccgaaggtgaccgccaaggtgatgaacgcggtcagggccgtacgtcctttagaacgtgtcagggcccgccaggcgttgctgaggacgaacatgtaattacctctcccgttctcctaagccgaacaaatcaatacggctctaactattgttgcgtttagtgaccgttttcttgcgcaatactgttatacccctcaatgaagtctgagaacattctgacagcgatgtggtagtcatgcggggatttgcacccggtatgggataaatcctcggtctatttcggtggcatcggtacactggcatgagatatgcgtggcgtcacgtgtgctccggcatgtctgcgattccggatttgcccggagtccggcatccggaagcgtggcctcgcgccgctggataagagtatgagctgagcagattttcgggcagggtaagtatgcgattcacttcagggcattcgagccataaggctgtggggcgtaggagaagacgtcatgccggtaacggaaaattcaatcgctccgcatctacgaatagcgctgtgaatcagcagacgggtcccgtaaacctgaagactccccagcacgtgggtggtaacggccgttcgctgatcagccgtacgccgatatgggcgcgagtggtggttgtactgctgctgacgttgctggccagcgtcacctgtgtgggcacgctctacgcggcatccgtctcgagaatggccacggatgcgcagcgtgtactgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaccgattgcagggcttctccctgaagaatggctcggtggacgtcagcgccctgatggatatgccggatatcgtcaagcaggcgcataaggatatcttgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacatgctaccgcaactgcttggcgaggacggcaagcgcacgtatttggtgatggtgcagaacccggccgagctgcgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatagcaccaccacggtgccgttcttcgcttcagacctgtacacggattacccggacttcgagcagcagaacaacttcgtttccgaagcggctcaagcaattatgaaccatgtgcttggcaacgcgaatgcctccaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcaccaaaacctgcggtgacgtctcggccagccagaacgccctgtattctggcgtgctggataagcgcatcacgacagccgtgcgtaacacgcagctggggcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgccccgtacggtggcgaaatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacgacgacaagaacggcggcgcggacggcggcaggaacgatgcgcataaggacgcgtcctccgatccctcggccggcctggacaccttggacaagctgaagagccagatcagctgcccggtcgatctgaagtccctggcgggatccatgtgatgaccatgcccgattccgtttccggcgtcgccggcaagccgcgcgacgtgaactacgatctgctgcgcgtggtggcgatgtgcctggtcatcggcgtccacgtgatcaacaactacatgcccgtcaagatgaccctcgccggcagcgcggaagtgacgcgatccgtactgttcgcgctgttcatggtctgcaatccgctgttcatcatggtgtccggccgattcaacctgacattcgatgccgcgcaaggcgccggtcggccccgacccaatggtctcgcgccgtacgcgcgctactactacaaacgttttatctcgctgattgtgccgtatctgctgtatgcgggcggcatgggattcgttgcctacctggtgattgatcatcgttcggttggcggcgctgtgtctggaacgttgttcgatctgttctccgggtatgacgattccgtctattggttcgtgttcatgcttgccgggtttgtgctggcaacgccgttcctggccgcgatgatgcgtacgataggccgatcgggagcctggttgctggtcgggctggccgccgccgtggccgctgccgagcatatatgcgatcttgccggatatccgttgacgttcctgcagtcattcccttggcgtggactgctgatctactacctgttgggattcgtgttggaatactatccgccgtccgcgcgtatacggcacggcgtgtatgcgttggcaccattcgccttggcttggaccgttgccacgccatatctgttcgccggccagcagatgcaggttggccgcacggtcacggttgcgttcgcgatggtggtaatggcgacgttcctgttcttccggtacgacgtgcacatcacgtcggcgcgggtgcgtaaggcgattatctggctggctggatattcctacacgatttatttggtgcactcgccactgtccaaggtgctgattggcccgcggattcccgcgcccacggacggatggtcgtatgcgggtatcagcgtgctgatgtttggcgctacgttgctggcggcgctgttatttgcggtgattgccgataccgtggtgcttaagcccgtgcagcgtctgctgcggaaggtacggctgtagattcggatacggcgctatgccacggtatcaaagccaggaatcccagcagcagaagcggggtgaacgtgaatttcgacatgccaaggccggcatcaaacggttcagccgcttccacgcagcgctcgccgctactcgcgagaacacggtcgaaggagcagaaacagcatcagaggcatcggaagcatcagacatatgtcccactatatatgaggtgttggtggtgattgagcgatatttgaaggcagttctggaagggtcctagacgtatgatttggagaacggttccaccattaatggtgtcaacgttcagttctattccagcaacggtactaatgcccagcgttggatgttgcgtaagtaggtttgatgagcatgacttcatctgatgagaagccttgaacccgtgtccacatttatgatggagggcgaataacatcaacgatttttagcacggctttgtctccgtcatttaatttcttggcgctgtcgatgccgctcgcacatccacacatgaaaagagccatgtcaatcatctgtagcccgtacagcatgcgcgaatcctcccattggaaaggcattttgatgcgtgccaaatcagaggggaaatatccttgcttatccaaggtatgagagatttgtggtacctgtggctggaaaaggataatgagggactccgaaaggatgcttaatggtaggggaggaagaacggtatatcgattcaatcggcttgtcgtatgtggacggataccgattatgcgcttgaggttggtgcgcgtattgagtgtgtggtcgaacaagctgaagatgagtgggggtgtcattgttgacgttcaagaaagcatggcagataccaggtaaatgatttacctaccttcatattttgcggtttgggctgacactaaaagatggggtgcgactcacggttgcgccccatcttttagtacgtcgctgtcagtgcctcttgttgtatgcgattttgttggtgtcaatgacgaaagtcttgcggtcattcttggccatgacatccaggataataccggcgatgatgagcagaagaccagcgatgaccagcatcaccgcgccgatcagcgtggggaagtgggtgaccacgccggtcttggcgaattcgaaggtgacggtgccgcagagcacaatgccaacgatgccgatgattaggcccaatccgccgaagaaggggaggggcttgtattcgcgaatcatgcggaagatggtgctcatgaccttgatgccgtcacctacggtgtccagcttggacactgagccttcggggcggtcacggtactggattggcatctcgtagagtcgcaggttgttgttcagcgagtggattgtcatctcggtctcgacctcgaagcctcgcgagagcacgggataggtcttgacgaaggtgaagctgaacgcgcggtatccggtcatgatgtcggtgacgtgcgcgcggaacaggtggttgatggagccgcgcacaagtcggttgccgaagttgtggaacgggcgcttgttctcttggaaataagtggatgagaggcggtcgccgatcaccatgtcatagccttcgagcaccttggtgactatgtcgggcgcggcggcgatttcggccgtgcggtcggtggagttgttgtcgtacacgtagatggccgcgtcgggcagcgccgcacggaagtcgcgcaccaccttgccgatggtcacctcttcgttataacaaggcaggagaacggcgacggtctcattttcgcctcaagcagggggcattgctatacgcgttgactcgtatgatgaggacaaaatagatacaatccaagcactgtaggaggggccgtcacgctggccgccggtccctcctacagcgtggtttcgatgcggtaacgggggcgatgtttggattccatataaatcttgccgacgtattcgccgacgatgccgagggagagcatgatgagtccgccgatgagccagatggagatcatcatggacccccagccggcgatggcgtggccgaacccgagcgagacgagcacgtacacgaacatgccaatcgctaccaggatagacagcagtccggcgccggtgacgaagctcagcggcttcgtggagaacgaggtgatgccctgaatcgcgaaggcgatcatcttcttcaacgggtatttggattcgcccgcttcgcgttcgccgcgctcgtagtagactttgctggtctggtagccgagtgtgggcacgatgccacgcaggaacaggttgacttcgtggtattcgctgagcgcgtcgagcgtctcgcggctcatgagacggtaatcggcgtgatcgggtaccgtctcggcacccatccactcgaacaccttgtagaaggcttcggcggtggtgcgcttgaaccatgtgtccttcttgcgtgcggaacgcactccgtagacaatctcgttgccgttgcagaatccgtcgatgaactcgtcgaccgcgttcacatcgtcctgcaggtcggcgtccatggagatggcggcgtcacagccgtaggcgcgcgcggtcatgagcccggcgaggagcgcgttctgatggccacggttgtgggagagctttacgccgccgaacaagtgtgcgtcgcgttcgtgcagattgcggatgatgctccaggtgtcgtctttggaaccgtcgtcgacgaacaggatgcggctttgtttgctgatccgtccggtttcggtaagatgtgcgactttggcggccagcacgtcggccgtgtgcacgagcccttccgcctcgttgtagcagggaagcacaaaatacacgaccggctggtcgcggcggtcggcgcgctcgccggaaccatcgccaccggcgctcgtgatgcccgctttctgcgtgtttgtctcgaagatcatcttcccatcctcatactcagttcgaagccgtctcatcccggttccggcccatgctcatgtgctatagatagtttagctgtttgcgtaatgtcgtgcgtgattttctcggttcggtcaatttcgatatttacatgttgatgcttgcgttcaggttcctgttgctgttcggcatgcgtattcgtgtcgcttgtcataaaccggttcttgatgtcatgagcttatcatgatgcaatcatgataagctcatgacagagtatttatcttcacgttatcatgagatttcagacgtgggtttggggtcgattggaggcgactgcttggatccatgtggtcgcaacaagtaagacaaataagctgatcaagggggatgatgatgtggacgaatgacgatatcgccgaggtgctggaacatctacgtgtccaaggcaacgatgacgcccgtttcgaggcgaaatcctgtgcgcggaccatcggcaccagcgtgtgggagagtgtgagcgcgttcgccaacaccaagggcggcgtgctgttgttgggaatcagcgaggacggggatttctcgcctgttccgggattcgacgccaaccatattgcatcgcagttcatggatggtatgggagatggcaatccgcaaggagcacggttgacgaatcctccggagtatgacgtttcccgatgcgagcagaacggcttgtcgttcctggtcatcgacatccatgaaaacggcattcagcacaaaccctgctatcttacggcgagagggccgcaaaccggtgggtaccgccgtatggacaacaaggatttgagattgtcgccaaccgaagtgttcgaaatgacccatgccctgacgcccagttccgcggatcgtatggttgtccctgaagccgacgtctccgatctgaatgccgaggcggtggacagggtgcttgccgagcatcgtaattccaaggcgttgcgcgggactgatactcgtcttgagcgcatgaccagattgaatatggtgaacaaggttggagaggtgcgtcttgcgggactgttggccgccggacagtacccgcagcagtactatcccaagctgatcattgacgtcgtcgcacatccgggtgtcgagaaatcggcggttgagggtccgcgtttcgtggatcgtgtgcaatgcgacggcaatatgccggaggcaatcgaacaggcggtggaggccatcgccaaaaacctgcgggctcccacgttcgtcgtgggggtcggagcccgtaccgatagcgagattccaaaggaggtgctgcgcgaggtcgtcgccaatgccgtggttcacagggaatatgatgcgcaattcctcggagaatccgtgaccgtggacatctaccccgatcgggtggaggtgtcgaatcctggcggattatggggtggggtcacgctggccacgatcggcagcggcgtgtcatgctgccgcaatgcgacgttgatgcagctgcttcatcagataccgtatgacgatgcgaatgatgtgaccgtggaaggcggtggctccggcatccctctggtgattcgcgagatgaaatcccgtgcactgggggaacctgtgttccgcgcaactcccgatcggttcacggtcgttcttggacgctacggcgtggagcagcaggagaaccgtgactggcttgatcatgtgggcgtccccttgactcgtcatgaacgtatggcgttgctcttgttgaagaggcatggcgatatgacggttccgcagttgcatgtcgcgctgtatctggattccgacgacatcagggtgattttgcatagattggtccaagcgaggctggccgatgaaatcggccctgatcggtacgcactagcggagaaggtcgatggtgaggagccgagtgggggccgtaagggtcttacggcatcggaatccgcgatactgtccgtattgtcggcggataagccacttgatgtccacgaaatcggccgtcgctcggggaagggccttcctacgacgcgcaaggcgttgagccggctcgttaaacgtggactcgttctcgccactgcgccgccgcgcagtagaaacaggaagtatcttctcaaaagataggatgatgccgtcgctggaatgtatggcggagctccgccgattttgcccgcttcgctccgtctgtcttatccgccttgctcattagactggagcacggttgaaaacgttgtgattacgcctgtttgcgcctgcctgttcccgcgtgtgagagtccggtcgaccatcggaacgcgtggcggtgtgcgggtgcgcgggatgggtgtgtcaaggagttacgcatggtggaaaagaagcggttcgacggctcggatgcgatggatacgacgggcatgctgcgtgcgttgcgtgcgcgtgcaacggcatccggcgcggtgcgcggtgtgactgcggcgatggcgtccgtcgcggcgatggcgatgttgggcgcggtgtgcgtcactccggccagcgcactcgcggatgtgaacgccgacgcggacgcgtccggcgtccggtccgcgacttccgcgacgcgtccggtcgcgaacggtgtgacggtcgccgatgagacggctgccgacgcgatgccggacaatccggatgccgagctgccggacaaggtgtccgccgagatttccgatgacgcgacggtggtgtccgagcaatatgcggctacgccggaaggcgagttgaaggacatcgagacgggcgagacggtcaccgatccgaagatcgtgggcacggagagcaagcagcccgatccgttggcgaagacggatggtgagtcgttcattccggtgagtgccgcggatgtgaaggagaaggtcgctgcgaacggcggtgacgtgaacgcggtctcctcgaagacgcgcgcggccaacgcgtcggtgaagctcgccgcgttgcagaacaacgagtacggtgcgcactggggcacatacaacggtacgcaggcgttcttcgacgcgcgcaacaacctgttcgcccagcaggcgaagggcgtgatcgacgtgtccgtgtggcagaacacgattgactggcaggcggtgaagaacgcgggcgtcgagggcgcgatcatccgtctgagctacggctggggcaatggtttcgacgcgcaggcgaagcgcaacatcagcgaatgcaagcgtctcggcatcccgtttggcgtgtacgtcttctcgtatgcggaaagtgcggccgacggtgcgtccgagggcgcagacgtggtgaacctgctgcgccaggcgggcgtgaacccgggcgacctgagctacccggtgttctacgatctggagaactggacgtacacggggcacaggagcccgacgagtccgagcgtgtacgacggcatcgtcaactcctggtacggcaaactgcaggcggccggttacaacaatctgagcgtctactcgtacacgagctacctgaacagcgcgctcaacagctccaacatccacggcaagacccgttggatcgcccagtatggctccaccatgcagtacaccgcgttccccaccaacgaccgcggctggcagtacacgagcggcggctccatcaacggcatttccggccgtgtggatatgaacgcgttcggtaactgggagtatcaggccggctatgacgtgcgtggactggaaaagctgtcgctgcccaagggcacgttctatgtcgatgcggtgaagcggctgaagtcgtcgttgctgatcgagaatggttcttcatccgcgggcgcggtggctcgtctgcagtcgggtacgcaggatgcgatgaagttccagttcattcctcaaagcgacggctcgtacgagatcgtgaacgtgacgtcggggcttgcgttggatgtgaagggcggcaacgccgtcgtgggtgccgcgattcagcagtggacgcgcaacaacacgtccgcgcagcgctggtggcttcgtgtggcgaacgagggcggcgtgtacatccagtccgtgctgggcaattgggtgttggatttgaccggcggcaatacggcggacggcacacaggtgcagctgtatgctccgaatgattcggaggcgcagcggttcgtgattaccgacgcttcgaccgtcatgccggaaggttcgacgcgtttggcctcgtccgggcagagcgcgatgacgctcggcgttgccgatggctcgtatgatgatggcgcgaagcttgaggtgcaggattggtcgaatgcggattcccagttgttccgcttcagtcgtgtgggcaacgggctggtcgagattcgcagcgtgaattccggcaagctggtggaggtcgcgtccggtaccatgacgaatggcgcgcggatccagcagtggccgtcgaatggttcgttggcgcagcgttggtcgttgcgtgacgcggggaacggcaatgtcggtttggtgaacgcgaagtcgggtcgtgcgatcgatgtgaccggcggcaatatcgcggccggtacggcggttcagttgtacgggtggaacggtacggccgcgcagtcgtggaagacttctgtcgcggagtcgaagcgtggcgggttgtctcgtctggcgggtgcgactcgatatgagacggccgatgcgattgcagctaccggtttcaaacagtcggattgggtggtgattgcgtctggcgagtcgttcccggatgcgttgtcggcttcggcgttggccggcgcgttggatgcgccggtgctgttgtcgcgtccggatgcggtgagcgacgctcttgcggcgcgtatcaaagcgctgggcgcgaagcgtgcggtgttggtcggcagtgagagcgtgttgtcgtcgtcgttggcatcgcaggtgaaggacctggtgtcggagcatgaggtgcgtcgacttggcggcgcgaaccgatatgacacgtcgctgagtgtgttgcgtgatgcgccggggaagcttggtttcgagaagtggtcggataccgtgatcgtggcgagcggcgaaggcccgtatgatgcgttgtcggcgtcgccggtggcgtaccggttgcaggctccggttgtgttgacgggtacggatggtctggataaggacatggtgaaggagctgcgtgcagccgggttcaagtcggcgctgctgatcggcggcgagaatgtgatgcctgtgaaggtggaatcgcagttgaagtcgttgtcgttgactcgtcttgctggcgcgaaccggtatgacacgtccgccgaggtggtggattatgcgttgcgcaagaagattctgaaggccgatggcgtggtgttggcgtctggagagaattatccggatgcgttggccggcggcgcgttggccggttcgacgggcaatgtgctggcgttggtgaacggcgcggacgcgcgttcggttgcgctggcggctgccgcccagtcggatgggaacacgacgatcgcgtatgtgttgggcgggacaagagtattcggtcagtggacggccgagcgcatcgccgccaaactcaacaagcacatccagtaagcggaagacccccggggtgcagttcatggcatcccgggggtcttccacactgcggcgtcaccgtcaaggacgattccggtgcatgtagctgattgtgttggcgtccacgaggaaggtcttgcggtcgtttttggcgatcacgtcgaggatgatgccggtgacgatgagcaggagcccgaccatgccggtgtgcacgaatttcgcggtgacgaagccgcacagcgcgagtccgatgacgccgatgatgaggccgagcccgccgaagaacgggaggggcttgtattcacggatcatgcggaagatggtgctcatcaccttgatgccgtcgcctacggtgtccagcttggagacggagccttcgggcctgtcgcggtactggatgggcatttcgaacagacgcaggtcgttgttcggcgagtggatggtcatctcggtctcgacctcgaagccgcgtgacagcacggggtaggttttgacgaaggtgaagctgaacgcgcggtatccggtcatgatgtcggtgacgtgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacgaaggtgaagctgaacgcgcggtatccggtcatgatgtcggtgacgtgcgcacggaacaggtggttgatggatccgcgtacgaggcggttgccgaagttgtggaacgggcgcttgttttcctggaaataggtggaggagaggcggtcgccgatcaccatgtcgtagccttcgagaaccttggcgaccatcgcgggcgccgcgtcggccgggtacgtgtcgtcgccgtcagccatcacgtacacgtccgcgtcgatgtcctcgaacatggcgcggatcacgttgcccttgccttgccttggcgtggctccttgcgtaccaccgctcccccagccgcggcgatttcggctgtgcggtcggtggagttgttgtcgtacacgtacacgaccgcgtccggcagcgccgctcggaagtcgcgcaccaccctcccgatcgttacctcctcgttatagcaaggaagcaacacggcaacggaaggggcagcagtttcacgcatgcgccccactatacgcgttgactggtatggagacatcccataaggtcgactgatttcatcgccgctcgttgaccgattgccggtctataatgcgtatatgaatactgaggcaatttcgcaattggatgtgcatcggttcggtcctttcgacaatgattatgagctgacgttcgccacccccctcgatcaatctgattgtgggagataacggcaccggcaaatcccaattgttgaaattactgtactcatgcacggcggttatgcatgatgcggttgatgattccgaactgacgaagacgaacctgcagaagaagctggcttccaaaatcgtgggagtgttttctccggattcgttgggacgactgacgaatcgtcaacgtgggcggtccaaggccgtcgtcggcatcacatatgacggcaagcagcatccacttcggttcagtttcaccacgaattcgaaaagcgaagtgaagatcgacagtttgccggagtcccgcgtggaatccacgccggtatttcttccttcccgtgaactgatgtcgattttcccggggtttgtgtcgttgtacgattcccgccagatcgcattcgatgagacatggcgggatacgtgcaatctgctgggcaggacaccgctgcgtcgtactcccggtagcgatgtggataaggcattgcagcctatcatgggtattctcggcgggaaagtggacgagtccgccggcaagttctatctccatcgaagtgaaggcacgttcgagatgccgttggtggctgaaggcttgcgcaagcttgccaccatttaccgtttggtacagtctggcgtgctgttgaatagcggcttcctgttctgggatgagccggaggcgaacttgaatccggccagtcagaaagccatcgtacagatggtgatcgagcttgccaatgccggtgtctaggtgttcatgggcacgcatagcgcgttcctcttgcgtcagttcgattatgagtcccgtaacaatgccgacgtggcgcagatcggctatacggcattgcggcgtaccggcacgtcgatagacattgctcaaggagcttccttggacgatttcgatgaggagcatctgcagacgttgaaggcggaatatgagcagaccgccttgctgctggacgaatgatgggcgccccgatggatgatatgagcggcaggtgattgcggtgcagacgttcgagcaggataccaacgtgtatgagtttccggacgagtgcgttgtaatgccggatttcgataagaagccgttctttaccaagctttccggcgcacaggcgattcacgccaaaggatgcgacatcatcgccattcctgatgaagtgacgttgtatctgatagaagcgaaggattactcccatagcaatccatcggaaaaacctccgaaggctccgaaactggcgtggaccatagccagtaagagctttgatacgctggcgtgtctcatggtcggagccacgcggtctgaggatgtcgaaacaacggatttctgccgcaaagcgcttgcctgcacgagaatcgtggtgtgtgctacggtcgagccgtcacgtagagtggacgttcagaacaaggccgataaccgctatatgatgcaattgcgggaatgcctgcgtcgtgaggccaaagggctggtgaagagcgggcgggatattttcgtgacgcggaatgcggaaaccgacaggaaaggcaaattctggacatcacattgggcgacatctcacgactgatcgttgtgttgtgaactacaagcaggcgattgatgatgagaatcagcgaagtcgaggtgttgagaggagatgttggtgtgtagagtgattgcgctggcgcggtcgtcgcggcgtgtgatatggctgccggtgtgcttggggctggtgatgggcgtcggcgggtacagcgccacgcgtggcgcggtcgcgttcggtgatcctgcgttgtacgtgcagtgtctcgtgtatgcggcggtgttctgcctggtgttcccgttgctgttctcgttgcaggaacgattcaaggaacggtgcgtagagcggacaggtgaaccgggagcggagccgtctgcgggaactgtcgagacggtcgccgagaccggagcggagacgcgcgccgtaccgcgtcgtgcgttggtgcggttcgagcatgtgctgcatgcgccgaacctgctgcgtgatgcgtcacgcatgttcgtgtgctgggtgccgtatgtcattctgttgtatccggggattctgtactgggatacgggcgaccaggtggcgcagttcttcggtatggctgtgttcggtcaggagccggggcagatttggaatcatcatccgttcctcgacacgtacttctatggttcggtgatttggctgggacatgcggtcagtggccattacgaggtgggtgtattcctgttgtcggcgttgcacgcgtttctcgcatgcgttgccgtaagcgcgttgctcgcgtatcttcgcgggcgtggattggcgcgcgggccgctgtccggaatcacggccgcgttctgtttcttcccggtgttcccgattatgttcgcatcgatcgtgaaggatacgacgttcacgatcgcgttggtcgcatggttcgtcatgtatctgctgctcgtggattcccaactcgcaagaatcgtccgtcccgggttcctcatcggtttcgtcgtgctgttgctgctggtggcgctcacgaaaagcgtgggcatgtatgtgatggtcgtcgccttgctgctgctggtggtcggccggtacaaggcgcggttcaagacggtctgcgtggccgtggcgattggctgtttcgcgttcgtcagcgtggtcttgccgaagaccgtgttcccccggttgaacatcgttccgggcgagcgtcaggccgccatcgtcgttcctatccagatggtggcccgtgtggctcatgcgaatccgtctgatgtgatcgatggggagaagcaggcgctcaacgagtatctgcccatgagctgggatgagatgggggagaagtatgtgccgttcaccacggatccggtgaccggttatgcgatcaaggacacgggcagcgtcgtcgatttcgcgaaggcgtggctgtccattgggctgaagcatccgcgtgcgtacgtgcaggcgttcatcagcgtggaatcgggttggctcgcgttcaacggcgcgccggcgaacaatgtggagccgcaggcgccgtacccggagatcgccctgcagtaccagccgcttacctcgaacgcgttgaatcccacgacgttcggcaagctcatgcccaatgtggagccgagcagggcgcaggcggcggtcaaggggctggttcgcgtgttgcaggacattccaatcgtcaacgtgctcatgtacctcacggtgtgggcgctgattgttcccgtttacctgctgtacgcgttgatacgccggaatcttagacgcgatgatgtcatgcggttcgtgccgtattggctggtcatggcgttcctgttcctatgcccggtgaccatccaattgcagaacgaccattcgtctcccactcgctacgcgttctcgatgctggtgatgggcgtggccatgatcggcgtgagtctgctgggaacgaaagcagacggcaacggaccgcaaatccagcagaagcgaggcttctgttgttttcgtgggttagatcgtgggttgtggtagtcggatgtcgagtccgccgcagcggagcacgacgagggcgatgaggttgctgacgtggtggaagccgtaggccatgcggatggtgccttgattctgttgttgaaggcctcgagcctggcgttggagtagcccagctggatcgtgcgcaggatgtccggccggcggcgtcggattttcttcgcgagttcgacgatctcggggatgcgtgtgggacgcccggaacacccagtggttcagttcggcccgggcctgttcgagcgggtgcttgagcagggtcctcaatagttccttgagttgccatgcgcggtagagctggcccttggggtccgtgtcctgcaggttcccgaaggcctcggactgtctgtcggtcaggtcgccggggttcttcaacacggcgtatttgacgccgcgcatgcgcttgacggatttctcgtcgccgtcgcggcgcgcctggttccacaggcgtttgcggaccttgtcgagcgcgtcgctcatccagctgacgatgtggaacccgtcgagcacgcgttcgacgttcggacaccaccggtcgacgcatgagtcgatccaccgggccccgtccccggtgaccagcctgatggaggcgcgctgttcgggcgtcaacgcctggaagaacaggccgaacacgtccctgccgtacccgtcgtgatcccatgtcacccgatgccgctcatggtcgacgaccacggtcaggtacgtgtggcccttcctgtggctggtctcgtccacgccgatcgcgtgcagtccgtcgaacggcgagggcatcgacgccttgacgcgttccgcgacccgatgggcgacggcgccggcggtcctccacgacacatgaagggaaccgctgaccgtcctctggttcgcgaccgtcatcagccacgcgcactccgcctcgaaatccttggtgaaccggctgcccggttccgcccacggcacccgggcgaccacgacgccgcacttcgggcagtccacgcgcggcatggcggcgaccaatttgacccctccagcagccgaaatcctggccacaccagctccgcacgccgccgccctggtcatacccgcggcgcctccttccgcagcgggagcatcggagcatgcccccgcacgtgggcgcacatggacctcgaggacgggtccggggcgcaatggcgagtcgacgatgcacgcgtcctcgaccaccgtgtttttgacgttgagaagccggttgaatatcctgttcatcaggcgctttgcggttgtttgtttatcttggtcgaaaacatcctacccggaaagcgctcttctcttactccctcaacaactcaacggagaaacccacccacgaaaacagcaatagcgccccataagtcgtattccggcgacgagcgcatcgcctatgtggagcccgtctcgtggcgtatcgcggaagcggtgtccgcgctgtcgatcatcgccatcgtcgccaccgttgcggtgccgcgcatcagccgttagcatcgtcagcgccgtcagcatcgtcaacatagcgcacggcactaaacgccaacgcatacgagtctcagcggcgaatcgcgttacgcgccactgcgataagccgcttcaccgcgatcacgatgaccaccgtcaccgcgtagatcacgacgagccgcagcagcgggtaccgggcgagcgcgtcgccgaatgcaccgtgcacgttcgccgtcagccagttgatgaccggcaggtggaacaggtatacgcccagtaccgcgccggacagtacgcggatcaatccgcgtgcacgttccggcaccgcgcgcaggcgcggctcgcattcacgcaacagcatgaacacggccacggactccaccacgcgcaccggcgaaccgttgaccgcatagttatggtattcgccagacagtccgccgctgaaatacccgttcgtccacaacgccgtgccgaacatcaccgccgcggcggcaccggcgaccagcagccacacccacgccggaacacgccattcgacatgatggatgagatagtagccgagcaggaagtacagcatgtcctgcgacatgtacaacggccaatgcagcaacgattcgagataccgctcggccacgcccaaccgttccagcagcggcactccccacgcgatggcgaagtccaccacgatgagatattgcatgagtcgtttgtcgtcggccgccaacgacagcagcggcgtgatcatgtacaggtagatgattgagtacaggaaccagtagaagctgttgatgtcatccgcgaggaagcgcttcacgaaatccacgggcccgaacgaatcggcgacggcctgcgtgccgaacgcggatgggaacaatccgaacagcaggtagcagacaagactcgccaacaccagcgccttgcccacacgccacaggcgcttccggaagaacgtcctcgtggagtatcgccgctgatagccgagcaggttcataccgctgatcatgaagtacacgggaacggcgaagatgccgaccgcctggaacgcgaccgcctccacccacgtgcgggatggctcaggcgagaacgcgttcaacgacacgtgcagcagaatcaccgcgagacacgccaccacgttgagcacatcaacgaacacccagcgtcgttgggtgtcaggcgcggtgtgcgcggaacctgcaacggtcttgtcgtcatccacgaccatgacggcaccggtatcgggcatagttaccatacgcactcttcccaatcctctcctattcattccaactcgttgtgcggctcagtcacgcatcagcagagtcgctccgctcggggtcgtaatcggctcttcgcattttggtgtgtatgggccgtgcggtttgattcggtgtgtgattgaaaaaagtgaatgaaaccgcgcggcttggtattgagtctagcgtgttcgatggtcgggtcttgcttggcttggataggctgcgtttgaatcccgtctcgcaaaggcacgtgaccgcgggttcgtgtgccggagtgtggctgatcggctgcgagccggtggacgggaccgtccggtattgccgggaatgcgggggcatgggccgggttcgctcctcgtggcggcggttcgtgcacatgcccgtcggccagcacgccgtgcacctgctggtgcgggtcagacggtacgagtgtatggcatgcgcccgctcgtggaccgacgacctgacccatatggccgacgagggcagacgtttgacggacgcggccgtgtggtgggccgttgccgaggtcgtgctcaagtcgaagagcgtgctcgcatgcgcccgtgacctgcactgctcgtggggcgtgttgaaccgggccgtgctggagaagggcgcggacgtgctggccgccgacctgcgccggctggacggcgtggaggcgatcggcgtggacgggcacgtgtggcggcacacccgtacgggcggccggtacgtgaccgtcatcgtggacctcaccccgcgtaggcatggtcggccggcctgactgctcgacgtggtcgagggcggaagcgagaaggcgttcgcccaatggctcgccgagcgcccgcagtcgttctgcgagaaggtggaggcggtcgcgatggatgcgttcgcgggctacaagaaggccgccgcacgtcaggtgccgcatgccgtggagatcctcgacccgttccacatcgtcaagctcgccggcgacaaggtcacggccgtgcgctgccggctccaacgcgaggccaccggccggcgcggcaccaggaccgatccgctctataggggcaggaggatcctgctcaagaccgccagtctcaggaccgacagacagaagaaacgcgccgacgagctgcttggcgacccgtccaacaagccgctcgccctcgcgcacggcgtctaccagaagatcatcgcctgctacgcgcaggaggaccgtgggaagggacggggcatgatggccgagctcatcgaatccctcgctgtcaggggatcggcgcccggatgccccggactcgtcacgctcggacgcaccctcaaacgccgcatggcggacatcctcgcgttcttcgaccaccccaacggcgcgaacaggccgaccgaggccatcaacggaagactcgagaccctcagggggcatagccctcggcttccgcaacctcgacaactacatcactagaagcctgctgcacaccggcggattcagacaagccatccaaacccacctctaaccacacgccatacacaccaaaatgcgaagagccggtgcgacaccctttcactggttatctaacaatctccaatttgaagggtgttgcactttcatctagacaacgggatcctcgacctgctcgacgcggcatgatacgatcagacagcaacgaaggtgttgcaaccaccactagaatccgcccgacggcgtgcgagccgtgatgacgttctgcgtgtcgttccgtactggatcgccccggcgttcctgttcctatgcccggtgaccatccagttgcagaacgaccactcatcgccgacgaggcatgcgttccagatgtgttgtggtgactggtatcttgttgtccgacaaatccaattgagacaactgacattcgtagtctatgccctatatgttgaggtgccccgaagattaagggatgagttatgagatatggacggcatacgctgcctcataggagagacggaatataggacagctgcatcagtgcattgtctcgatgggaaggaattcggccatgattttaaagaagattgctgtatgcaccacgattgccggtctatgcacagcactgattggcgcagccgtgattcccgcatcgagtgtggaagccaatagcactaatgtaatccgtctagctggcgacactcgatatgacacaatgagccgtatcatacaagctgaggttccaggaacttcagagtatgtcgttgtggcatcaggagacaatttccctgatgcattggcagcggcaccacttgcaggtgctttgaaagctcctatcgtattgaccagtggtaatgtgttgtctccgcaggctgaacaacagataacgaggcttaaagcctccaaagctgttatcattggaggagttaatgcgatatccagagcgaccgtgagtagaatacatggcctagtaggttccgtccccatccgtatttcgggggaaacccgatacgaaacatccttgcaaatctatcttcaaggcaaagctaggttgggggttcagtggtcgtccgctgaatctatcatcgcgacaggggagaattttgctgatgcgctatccgtgagtgcatatgcatatgcagaaaaggcgccgatatttttggcgaatccgaaaaacggtttcagctctgaaaccttacgagcgatatctggcaactttaggcatcagctcgttgtaggtggtgagaacgctgtccctgagctggtgattactcaactgatgtatggaacttcaggcggagtgggactccgtgtctacggggaaaacagatacgataccagccgcgcgcttgctgactatatgtacgcacataatgctgccgtaaataattcggtatttgctacaggtgagaatttccctgatgccttggctggaggtccacttgcgggacgtagtaacgcaatggtgttgctggcgaatacgccagattctccgtccgtgcagtgggcgcacgaacatagcagtggtgtgaatcgtgtctacttgttaggtggcgctagtgccgtgaacagagcgacagctgatgcagttgccaatgctttcggcggagagcacatcattgatattgatgccgtctctaggagattgcaatcagccaaggaagcgcagacggcagctgaagctaagcaaaagagtgccgtgcaagccgaagcgaaagctaaagcagatgctgacacgaaacaaagcgaagctgacaatgccgttcgtgcatatcaaatagcatcggcagatgccgcagcaaagaaaacggctgcggataatgccacttcgcagtgggataaaggtggcagaggtttctatgagacatatggatataatgatgctctaggattctttgacagtgatagttgggaaagtcgacaatatcgtgaagctgttgcggaaggtaatatcagacccaatgattcgggcagctcatatcaactggagcacatggttcaagcgattcctacattgaaaaaggttaatgaaatcagaaaaggtcttggacttaacgaactcaagtggagtgcgtatgaaacggcaatggcccaagcctgtgcggattataatatatattccccgtggactggacatggtttcaatgatggttcgcaaaatatgtctactggctatagcgaaccgactgaagggtggtataccgaggaaaaacggatatgggatgccgctgtagcgaaagattccagtctgactcggtacatcggtcatgcgtatcagttatctcaggataattttgggcctttcgctgtttggtgtgggtgagtgggtcggggggtggtggtgctggtcggccgaccagcaccaccaccccccgacccactcacccacaccaaacagcgaaaggccttcatctttccgtttttcgcaaaattcatattgacatttttgaatttatgaatataatgaggatgtaagttcaaaacagcgaatgtgaggtgagattcgtggcatctgcatacacagagaccataaaggtgttcaaagcattttgtgacgaaaaccgtttacagattttagaattgctccgcacaggggaaaaatgcgcctgcaaattgcttgatgatttgcatattacacaatcaacactttcccatcacatgaaaatattgtgtgatgccgacatcgtacaagggcgtaaagatgggaaatgggttcattactccatcaatcccgaaggcgcagagcgtgctaaaaaattgcttgagcaacaattatctttagttcctcatgatgagcaaaacggaagttgctgtaggtaaaataagccatctgtaaagggtggcttctcttttggacaacatttcgatagttttgaatttatcaatttgaaaggagacataccttatggagattttacgattaacgtggcttttcattcaagatcaggtgcttggaatgaagtggctgaacacggtaattggaaatggtttatccgtttttgggttagacacaacatcccgcttgggtgggagcatccagttttttctttacgatgtggttaaaattaccgtgctgctctgtgtcttgatttttgtaatctcatatattcagagctatttcccgcctgagcggagcaaacggatactgggacgttttcatggtatctgggcaaatatcatcgctgctctgctgggaacggtaacgccgttctgttcctgctcctctattccgctgtttattggttttaccagcgctggacttcctttaggcgtaactttttctttcctgatttcatctccgatggttgatctgggaagtttggtattgttgatgagcattttcggggcaaagattgcaatcgtctatgtggtagttggcttggtgattgcagtaatcggcggtacagtcattgaaaaaatgcacatggagaactacgtggaagatttcatccgtaatgcaaacagcgtggatgttgaatcagatgcactgacagtgagggatcggctgatcttcgcaaaggaacaggtaattgagactttcaagaaagtgttcccgtatattttggttggcgttggtatcggcgcaatcattcataactggattccggaaagctggattcagacggtattgggaagcaacaatccatttggtgttgtgttagccgtgttggtgggtgttccaatgtatgcggatattttcggcacgatttccgttgcggaagccctgcttgcaaaaggagcgcagcttggtacaatcctcagctttatgatggccgtcactacgcttagcctgccgtccattattatgctgaaaaaagcggtaaaagcaaaactgttaggactgttcatcgtaatctgcacgcttggaattgtcattgtgggttatctgtttaacgtatttcagcatctgttgatttaacaaggataaggtgtaaccatacaaaatttgaaaggagattctattatgggactgttcggatttggcaaaagaaaagaggaaggaggaaagactgttgcttgtgcttgcaatggagcttgtgaaacgtatgaggccgagactgtaaacggtagctgctgcgatgaggcaagcaacagtatttgctgtattaaggttttaggcagcggatgtaagaattgccatgccttgctggagaacacaaaagcagcactgaacaatatggggttgtctattcaaccggagtatatcactgatatggagaaaattatggcctacggtgtaatgtctatgcctgcgttggtggtcaatgaaaaagtggtgtctatgggaaaggtgctgaaagctgctgatgtggaaaaactgatccataagttggggtactaaaagtggagaaaaagagagttgcttttatatgcgtccacaattcctgccggagccagatagcagaggcattagggaagcattttgcttccgatgtgtttgaaagctattctgctggaagcgaaaccaagccccagatcaatcaggatgctgtccgcttgatgaaagagctgtatgggattgatatggaacagtcccaatacagtaaaacctttgacagcatcccggaaccggatattgcgatttcgatgggctgtgatgtgggttgtccctatattggcagagcttttgacgataactggggactaaatgacccgacaggctgcccggatgaagcgttccgggaaataatcagtcaaattgaggggcacattatacggttaaaaatacgaattgaaggaggtgtttatggttgaaaaaagaagctgatccggggatcaatttttttcaacggtatctgacaatatgggtattcctgtgtatggtggtaggcgtattgctggggcattttgccccagtagtccctgcattactggctcggctggaatatgcccgtgtctctatcccgatggctattctgatttgggtaatgatatatcccatgatgctgaaagtggacttcaacagtgtacgaaatgtaggaaaaaatccgaaggggttgtttgtgacatggattgtcaactggcttataaaaccttttacaatgtatggcattgccagcttgtttttcttcgtgattttcaaggcatttattacgcctgaccttgcggtagaatacctcgccggagcagtgcttttgggggctgcgccttgtacggcgatggtgtttgtatggagtacgttgacaaaaggaaatccagcttatacggtggtgcaggtggcgaccaatgacctcatcattctgattgcttttgtgcctatcgtaaaatttttgttgggcgtttccaatgttagtgttccctttgatacgctgattttaagtgtaatactgtttgtggttattccactggcaggcggtattttgacccgtgtatttgtaacccgcagtaagggaacagagtattttgaaaatgtgtttattcacaaatttgattccattactacgattggtctgctgcttacgctggtgctgattttcatggggcaaagcgaagtcattttagaaaacccgctgcacatcatactgatcgcagtgccgttgattttacagacatttttgattttctttattgcctatggagcctgcaagttgttaaagttaccgcacgatatttccgcccctgcgggtatgattggtgcgtctaatttctttgagttatcagttgcggttgctgtcgctctgttcggtactaccagcccggcggcacttgcaacaacggtcggcgtactgacggaggtgccagttatgctgacgctggtgaaaattgcaaacaaaacaaagcaatctttcagataactcaatgctacccaatttcgatgactttgcgtatttcgctcgaatggtttttgaccgttcgggcgatttttttattttttgaattcatcacttgacattgtggcaaagatttgccagtcctcggcaactctgcgccgcgggcgatatctcgcaacccctgcaacgggccctaataacgatggaccatcaccgcttgatcacttgcgctcgcgataatccttgaccagctgaatggcgagggccgcaacgccgcacagcacaccgccaatcggccacggcagccagaacatcgccccatccgcggcgcttgacccaacggccgaccaatcgccgcgcaatgccgcagggttcaaaaacagcaggcacaggccgatcaccgtggctatcaacatgatgatgccacacaccgcaccggtcagtttgacgtagacatcctgctcacccgcatgctccttgcggtcgtcctcggccgctttgttgtatgcgttgatattgagcagactgtatctcatgccgcagtagacaaacccgaaaacaccgggcgcacagagcagcagaaaaatcgcgttgggccacccatcggagacgccgagcatgtcatcggcatacaccgtcaccgcaatgccgatcagaatggccgcgaggccaccgacgatgccgattaccagcagccgcaattctcggctgcggtcctccccggtgtagaaatcttctacgtatgggtgacgccgtttgaagtcagtacgcgacagacctcctggaatcagcatcgccagccccgcaatcacacccacgcagatgcacagaaacgtcagaaaatcgttgagcggcgtcgctccgagaatggaattgctggaatcgaacaggttgccgatgccaaccccggcgacaatcgccgcgacaccgccggcaatcagcagcgcgaatcggcggcgatgttcatcgtagccagtgatatcctgcgcaagctccgcgataggagcgattatgcccgccgttttggaagaagcggctaaaggcgatgccgtctcagccgaggagtcaacattcgacgaaccggccgcagaagccgacgcggcaggccgactcacatcgccaagtaccagatcatcaagcgtgcagccgaacaggtcgcagatcataagcagcttgtccatctcgggataggccttttcggattcccatttcgaaatggcctgacgcgagacgccaagcaacatggccaatcgttcctgggtcaggttgcgttgcgcacgtaggtactgcaggttagcgcgaaaactcattggaatgtcccttcatacgtaatctttatcatgtcatgttcggccgatggactcactatggcatgccgtccatgtcacccgccaccatctttgggttgcaatcgccggttattcgagcgcaaccacaagttgcatcggcggaattccgccattccgttgacctgagcagctttaacatcgcactccacgagaccgaagcttttccagccatgcgagggcagcttgtctcacctgccaccacgaatccgcttcgacccacgtacacatctgtgtacagcagcgctcgcaatcggttacctacgacccatatgatttgctgagcgaccgcaaaacacgcaatagccgagacaacaccgtcagcgttaaagcttaaggcgactacttgcccaatagtccggaaatctggctgatgatgtcagcgggcagtcctgcttgttcggcaatggatccgaggtccagattggcaccctgctcctgaattgcgccagcgacctgactgatctggtcggcggagatgttttcctccgccagcgcctgcagctcgtcaagtcggtcggcgttcaaatggtcgccaacgacctgttgatttcacccaactgatcggcattgaaatgctcaccgattaccgccggcaaatcaccaatcgaaccgagattgaaatccccgccaagcacattgcctagattgtctgcggcaaaatttttcaggctatcgaacagtcccacatgtgccgctggtactgcttgttcagcaactgctgcagagcatcgcacagaccctgcatcaatcgccgctcttcggcagacaagtcccgcgtgaaaccaatctctgcctttgcgctcatcagctggggagctcacggtcacactcatgcgtcgcagaccacgagcctcacgctcctcctcattccacatctgtgttaacaacatgtgttaatcgcatgcatcgccaccatgattccccaatgatttcaagggttccccggtctcactattgtttcttccctaaaacggcctcaatcatcggcaccttcctggtggccaccaccacgtccctgaccggcaacgcttcgttcggcgtgctctccatcgccgtcctgctcgttgtggcgctcgttttcctgctgctgcagaaagacccgacgcgcgcaaacgtgctgagacatcgccggtgaaccaagttctgcctttttaccgacgccagctcgcataagcaggaatcaaacgtcggcgctgggacacagaacgggaatccgccgacgttcagagtatctgatgtcggtgccgggccatgttttggacgccaccgacacaagtaccactcttggcgacggtggtggggcatccgctgtcccaccaccgtcgccaatcgttctcagcggcgttgacaatccattatctgtccctccaacgccgccagacgtccacagcgtcggcgacggtccggattttgacgcaccaccgatgcaaaaccattgcaggcggtccgtacggaacatcagccgcgaccaccgaacgagcaccaaatgcggcatcagccgtgacaccagccgcacttatcgacgcgcccttaccgcgtcatcacgtccatcaatacaatgactcatcggcatatccggctgcagcccaataatcgtcggccgatagcgagcgattgaaaccggtggcatgatcgcttctgaggtcgccctcgccaccgagatcgacatcgaaatcagtaccagcatcggaagtaccgccggacataccggcaacggacctgacttcggttttcagcaggtatttctccgcgaaattcagcgtggtgcacaccatcgcaaacccctttccatgccgttgccctggctgaccaagacgtccttgtgtaagtaagtatggcggctccccttccgcaccgccatatccactatggaagcacgccgcggcacacgacacaagccccgggacatatgaagaagttatggccggttcaaagcacccgtattacagcccaaacggcaccgcgcgcagcgggattgcacgacggccggacgccactcataatcggaaaccgctcacagacaaatgccacccgaggccggacgccatataaggaaccgtggcacggcagatatagaagatgcccgccatcatagactgacgagcgtgatatcgggtgggcgatgtaggaatcgaacctacgaccccttcggtgtgaacgaagtgcgctagccgctgcgccaatcgcccgagcttgtgatgaaaaaaccggcaacattctgccggcgattcatcgagtgggcgatacaagattcgaacttgtgaccccttccgtgtcagggaagtgcgctaccactgcgccaaccgcccgggtcatcctcaggctgaatcaatcatcctgaaccagccatccgagagcggacaacgggactcgaacccgcggtctcaaccttggcaaggttgcgctttaccaactaagctatgtccgcatgtgttaccttcacaggcaacaggtgacaaagatacgccaatctcaggaaaaagccaagcccccgcgtgtcccaccggttttccaacgattatcgggtgccgccatgcacataactcgcggtggccgtatacagcagccaagcgatgggcatggccagcataaacagcgggtagaaccaagcgatgggcacattgcacggccatggccgtggaaatcaggaacgcatgacgataaccgatcagctggccgaagaggccaaggccttgatcggcgaccgtgccgaagtgaagttcctgaactacgccgacgtgccgttcttcaaccaggacgaggaattcccgaacccgacagccgccgtggccgccgccttcctggcgctcgttgcggagtaatcccgcctgaatcttggttacgttccgcctcaaggcggaccagctgcatcagcaatgtgccgaacccctctgattgattccaatcagaggggtcgctgcgtttcaaggggctgatttggccttctccggaggtctactcccgtttcaaggggctggtggctgagtagacacgggccaaaaacggcgtaatgacgttagcccggagccgtttatacttgcggtttcccggatgaggagcccctcgaaacggagatagacctccggaataacccaaatcagcccctcgaaacggagttagacggttgggatgtcggaaagaacactcacgccggcccaagaacccccactatgtcagatatcgctgcccagcacgcaatactgaccgtacagcacgacccgtccttcatgaaatcaggcacagtatgggcttcatccctcaacgcgcgataatggcggtatgacgcaacgacaactgatgcgggccacagtcgaaacgcccatcggccggatgatgatggcctccgacggcgagggacttaccgaactctgtcttgaagactggtggtgggccaccgatcaccaagccgttctcgattcgaatcgcgaatccgatagtgaacccgacgtattccgtataacccgcgaatggctgaccgcctatttcgccggcgaacgccccggctcggatcaggtgccgcctttgcatcccgccggcacgccattccaacatgaagtgtggaatctggtggccgaaatcccctatggcatgacggtaagttacggcgaactcgccgccgaattggccgaacgacgcggcggcggccgcatggccgcgcaggcggtcggaggcgcagtgaagcgcaatccggttaccatcatcgtgccctgccaccgcgtagtcggctcgggccgcgcgtttggcggctacggcggccgactcgacatcaaggccgagttgcttgaactcgagggcgtggatctggcgcgcttcgatctgccgaacctttgacgggcccagcggtccgcctcgtcaaaaaggattgagtggttaaccctcccgccggcgggagatggcgcgtagcgccggagggtggtcggctggctggcatcgcaaccctgctacccgacaattttcgacaagccgacgggaatccttccacgaattgttcgccgtcggtgcagtcttgctcgatcgcgccggccaaaaccgtacaatccctacaatggaatgcatatggttaattgctgcgcgcagccgcacggccgcacgcgatcgcaagaccacgcagcccaaggggatatgcaatatcaacggaagcaggaggtgcgcatgaccggcattatcgattacgcgcacaccgaaacgcgctccttcgccgacttgccgttcaacgaaatcgacgccttgatcatctccacgctcatctatgaggatgtggccagtgtctgtccgacgttgatgctggatgagacgcggtcaggctcgttcgccgcacgcattcgcgctttcgaacccaagcatccactgatctggctgaagggtatctggcatcccgagcttgaatcggtaagccttgacgaggccaaccgcgagctgcatcgttcgccggaaacacatgccgacgacaagccgcacgaagcccaaatggtttcagtggtcaacccggacctgacccacgacctgttccaggccgcaggcgaaaacccccgctacgccaacgttcgcctgggcgcggtggtcgagcacatcaatcagggtgagcaaacccaattcgccgccgccaccttccaactgcccgacggccacaagcgccgaaagccgacctacaaaggcacgttggttatttccttccgcggcaccgatgattcgctcatcggatggaaggaagatttcaatatggctttccagtatccggtgccggcgcaacgttcagccagcgcctatctggatatggtggcgcgactgtgggagggtccgattattctggtcggccattccaagggaggcaatctggcgatttacgcggccatgaacgccgatcccaaggtgcgcaagcgcattcagcatgtctattcactggatggccccggtttcccgccggagattgtgaccagccccgcctaccgcaccatccagccgaaggtgacgaaaatcgtgccgagttcgtcgattgtgggcatgattttcgagaccccggagccttgccgcgtggtctcttccgattcggatggcatcatgcagcattccgccttcacctggctattggatggtgaccagttcatcaccgagccggatttgagttccagctcgcagttgtttaacgaggagctgaaccattggatcgccacgcttacgcccgaacagcgcgagcgtgcggtggatgcgctgttcaccgtgctgcacgccaacggcgccaccagcttcagcgaggtgatgagcaacttccccgcttcgattccggcgatgcttggcgcgtacgttgggctgacccccgcagaccggcgtcatttggttgaggccctggcgatactgttcaaggcgtccacggccaaacgcaagccgacgcccgccccggcttccgcaccaagttctgcgacctccaaagcaacagccgagatcccagcagaaactgcagcaggagcagatagcgcagctccggccagagccgatactgatgccgatgccggcaccacagcttcgccatcagcggaggacgcaactgaaatcgccgattagctcatagacatgtccacaaataatagttatactgcccaataagttattagacagcgtgaccatatcacgctggtgcatcaggaggaagagatgccacgtccacgccatgattccgaggtgctgcccgccaaagaacgcctcgagaacgctttctgggaattgctcgccgaccgcgactatcgcaagatcaccgttaccgacgtggtgcgtgaggctggcgtgaaccgtaattcgttctactatcacttctccagcctgcccgaattggccgattcagccatcctgcatcaggtcgaatcgattccgatcaaccgcacccccgatccgaacggcaatcccgaggaacaatggcgagaccgcgtcaccgccacgctctccgatccagagcagcgtcagcgcctcgaccacctggccctgttggcaggcccgcacagcacgcttgaactgaccgaatcgctgcgcgacttctgccgtctgcaaatgctcagcacattgcaacgcgaccccaagaaccttgacctgaaaaccgatctcatggtcgagttcaccgtgggcggcatgctcgccgtgctgcaacgttggcccgaattgagcgacaccatcgaaatcaaagacctgcttaaagaagatgtggccgtgctggccatgggcatatacctggccatgagccaaaaggacatgcttaattactggaatcgcatcttcgtgcacaatgcgcaggattcgaccgcccccggcatgccggtcgccgccacgcatgccgcgccatccaccatctcatcgtcgaacgaccccgcaggattccccgggtacaccgcttgaccgaaaaccagcgagtctggattgtttccgccgcacgaacctcgcgtgaggtttctcacaaggcgcaatcagcctctcatgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgcccagtcctcaccgtcgatttccgccgcgctcaaccactacatcggctacgagcacgcggccgacatcgccgccgaagccgtacataccggccgtaccgtgcgcgaggtggccggcgaacgcaccgacctgcccgccgagcagttggacgagattctcgatccgattcgactggcccgcggcctcggccagacctgccgcgaacgccaggagtagcggaatcgaccgtaggccgattccgctttctgccaccccgtctccacgacttcaccagaaacgaccgatacagtaggcgtatgactgaatatgcagaagacatcgcacgctggtttcaggtgaacgccggcaaactcatctggctgaccattgtattggccatcgtatttgtggccgaccgcgtcatcagccgcgtgttgcgcaagattctggacaattctcagattcccagcgcctcgattttcgtgaacctcacgcgcgtgaccatctgggtcaccggcgcagcgatggtactgcagcccgtattcggcatcaatccgaccacacttatcaccgcccttggtgttggaggtgtggcgatctcgctgggtctgaaggatacaatcgccaacatcatcggcggcttcggcctgatgctgggccgcgtaatccaacccggcgatctggtgaccattcaaggcgtcacaggcaccgtgcacgacatcacctggcgtcagaccgtggtgcgcacccgttccggagacatgatggtcatccccaattcggtactcaatacggccgccctgaccaagctcacgccggtcagcgaaggcatggccacgcttgagttcacggccaaggcctccggcgacccgtctgcgatcagtcaggatattctcgaccgcgtaaccaaagccaccgccgacgtggcgctggagggtcagccgccattggtcaagttcaccggcttctccccttacggcatgaccggccaagtgcttgtgttcgcgcgcgagggtgtgctgccttccaccatcaaagatatggcggcgcgagccatcgccggttcgggcaccgaataccttgttgaagatggcggctcgtcaggcaatctgtgatatctcccggctcgcctctctgggtccggctatgacagtcatgcgaacagcatccaaccggtaagcatcacagtcaacagtaggtacgcgataacgccgggattggcataggcggtgcgtattttaagccccgcaggcaactcctctggcgcaagatagaactcccagctcttgcgcttggtgataagcagcacgataccggcaatgcagaggcccaacatcactgtgccgtacaacatcatgatgcccatgtcgcccatgttgccggcttcagccatacgcatgatttcggcctcgctgaccgtgccgtcgaggatgcggggatcgatctgttgtatcaccaatggggcgagtactgacccgttcaggttgatcagcatgtgcatagccaccgaataccgcagtcgggaggtgcgcgtgtatacatatccgaacatcagtcctaggccaaaggcgtagaagaactggaacacgttcatatggaatagcgcgaatgccaatgcggagaatatgattgcggtcttctctccgtaccggcgcaggcgggagataatctccttgcgaaaaatccattcttcgcaaaccggtgccaacaggcctatgaacaatgcgttcacccgccagtcgctgccaagaatcacgtcgttgatgcgattggtggcctgaccatcagtggctccggcagacaatatattgccaatcatattgcccaagaacattaccggaatgcacatgacgaaaatctgaatgaactcccccgccttcatggggtactgccgggtgcgaataaccggtacgcgagtgaaggccaacatactcagcggcatggccaccacatacagcggtccggaggaggcgagcagcacagcccaagcgggcacatcggtgccaagcagcgttcgtagtgcttcagtggccagaatattcagtccgatccagaacaccatcataatggcgagcgccgagccgattgtcgaaaaccggcgatgggccgtgaaccaccaatcgcgtggagattgttgcggctgctgcgattgctgaggtgcctgcggctgctgcgccggcggcattggttcgctcatacttatcccccatagttactggccgcaaacggaccgatcacacgtgcaatactcttcaagaatacggcacggcgtttcgattgcattgggaatgggggaggaaatcatcaatgggcaaggaatgatcaacgtcaatcattcccaatgccgagaaagtcccctactctgcaagattgctgtgggacggcacgcgataatcgcccaaaaatcgccgccgtcccacacacatcattgccgataagccattcgacgatcgtacagtcacaaaaacagaacagaaccgcacgatcatcgcaacgccattcagcaggcgagcgcggcgaccggacgcggggtgacaatcacgtcatcgcccaccgccagaccggccggcagctcgctggcgggcagctgcacggtggccttgagctgttcgcccttgttccagcgctggtattcgccggaggtgatgaccgtatccacgcgcaccaaggagccaaggaagtgaatgacctccacgcgggcgcgttcgccgacgtgcgaatcgctgctgccggccaaggccagcgtcaggttctccgggcgcacgagcacggccacggaatcgcccttggcggagccggcgagcagcggcacgcgctggccgaagaccacggcctcgtcgccattggatgcgccgggcaggcggttggtgagtccaatgaacgtggccacgtactcggtggcggggcgctggtacaggttctgcggggcggcgatctgctcgatcttgcccttgttcatcacaccgatgcggtcggccacggccagcgcctcttcctgatcgtgggtcacgaagacggtggtggtgccggtggtgagttggatgcggcgaatctggtcgcgcagctggacgcgcaccttggcgtcgagggcggagagcggctcgtcgagcagtagcacgcgcggcttgacggccagcgcgcgggccagggccacgcgctgttgctggccgccggacatctgctgcgtgtacttcttggcctgatcggcaagtcccacgagctccagctgttccatggcgatcttgcggcgttctgccttgcccatgccgcgcacttcgaggccgaattccacgttctccagggcggtcatgtgcgggaaaagcgagtaggcctggaacaccatggccatctcgcgcttgttgaccggcacgccggtgacgtcttggccgccgaccatgatgcggccgccctggatgtcttcgaggccggcgagcgagcgcagcgcggtggacttgccgcagccggagccgccgagcagcacgaccatttcgccgggcttgatgtccaggttgaagtcgtcgagcgcgtgaacggtggagccggggtagatcttgacgacgtcgcgcatctggatggagccgccgccgcgcttgacgctgtctttgagcagggccttggcggccttggtcacgtccttgccgcgcacgccttcgagggtggcggtgggatcgttcttgaaggcgtcctcggcggcagcggacgtggtggcgggtgccgaaacagaagccgcggcatcggcaccggcatggcgacgggtgaaaatcgaattgctgttcatcaggttacttaccttcccttgacttgcgcattgcgtcggagatcaggtcgagcgcaacgaggagcaccgcaccgaagagcagagccagcagcgacatggcggtggagatttgagaattggactggccgagctggtagagcgcgacctgcaggttcatacggccgagcagcgaggcgacggtgtattcgcccagcaccacggcgatggagataaaggatgccgagagaatcgactgccataggttcgggatgatcaccttgaagaacaccttgggccaggaggcaccgagcgagcgggatgcctcgaccagcgtcttgacgtcgatggagttaagccccacggcgatcgcgcggaaggcgaacggcatcacgagaatcacgtaggcaaagcacagccagattgggttggtgctcagcacgtcggcggacagccagcggtagatcgggcccaaacccaccaccagcacgatggccgggatggtcagcggcagcgtggccacccattcgatcgcgcgctccaaaaccttggagcgaatatgcacgatgaccatggtgggcaccagcagcaccagcatgatcaccacggtgaccgcgctcagggccagcgaggtgccgatgccctgccacagcacggtcaggtcggcacccagcgactcgccgttgccggtgaaaatcgcgatccacggcgcggccgaccagcggccggacagcgggtgacgcagggtgaagatgagcatggccagcagcggcacgaacaggaacgccagggtgacgaacaggatcacgaatttgatgatgctctgtttacgcgcacgagcggcgcgcagctgcggcggcttggttgcggaagtttcggtcattgccaacgtccggccctcttttccacggcgtggctcaacagcatgacgatggccacgacgatgatcattgcgaatgccagcacctgggcaaagccctgctggttggggtccagttcgttgcgcatggcaccttggatcataagcggcaccagaatcgaacgctgggagaacagggccgcggcggtcgcgtatgcggagaacgcggaggcgaacagcagcaggaacgcggagatgaagcggggtgccagaatcgggcaggccacgcgcgtccagtactggaacgtgttgccaccgagggattcgcatgcctcgcgccactgtggacggatcgaatcgaccgcgggcaggaagatgatgatcatcagcggaatctggaagtagcagtagatggtcaccaggcccggcaacgaactgagccagttcgggttcacggtgtagccggtcagtgtcttgataagcatggtgccgataccgttgatgccgatggtggcgatgaacgcgaacgcgagcatcacgccgccgaactgagcaagcacggaggagatggcggagaccatacgacgcagcaggccgttcggcttggcaccaatgaccagtgcgtaggaagcgagcgcgcccaccactgcgccgatcagagaggatgctaaagacaccaaaatcgaggtgccgaatgcggcgatggtgttggcctcgaacatcttattgaagttcgcgagcgtgaagttgccgctgcgatcctggaatgcaccgacaatcacgatgacggtgggtgcgagcaggaagcaggcggtgtaggcgaagaacgggagcgtggtggcgagcgtgcccagctcctggcggtgcttggccatcgccgaggagagaggagaagcgggagtagcggacggacccgcagccttggcggcagcaggtccgttcgatgcaatgggtgcgattgcggcggtcatcggtctgtgcctcagttgccgatcgtcttgtcccagttgttctggagccactcggtgatgcgggtggagtcgtcgttggtgtaggagaccggctcgccttcgatggtgatggcgtccttcagagtggcctggtcgacggtgccgtcttccttcatggaatcgagcagcaccgggttggcgccgcccttgaaccacaggttctgggcgtcggcggtgtacaggtactcctcccacaggcgggcggcggccgggtgcggcgcgtccttgttgatggcctggttgtagtagctgacgacctgggccttcgggaaggtcttgtacttccagttcacgcccttgtccttgagctccttcttgtaggaggcctggttgtaggtccagtcgtagaccacgccggtctggccggagtcgatggtgccgttggtcacgtcgacggtggtcaggttgccggcttccttgagcttcttgaagtagtcaaggccgggctgcaggttgttgatgtcgccaccggcgagctggttggccatcaggtagccgttgaaggcggcgccagcctcggcgggcttgccgttgagggccacggtgccggcgaacttcgggtcgagcaggtcgtccagggagctgatgtcgccgtacttgtcggcgttccagcccacggacatgatgccggtgtagtcggcgtagtaggcgccgtcggcgtccttggcggtgtccgggatcttgtcccaggcctgcaccttgtacggggcgaagtagtcggtggaggtggcggcgatggcctggccgacatcgaagacgtcgggggcggcgtcggtgcccttgttggtcttggcggcgtcgagctcttccttggatgaggcgttcgggttgagctcggtgaccttgatctccgggtacttcttcttgaagctctcgatgacctcgccgtagttggaccagtcgtgcggaagggcgatgacgttcagcgcgccctcttccttggcggccttctcgaggtcttccatggtgccgaagtcggcgagggaggtggctttggcggacttttcgttcacggtgacggccttgccggtgctttcgccggtgccatcggaggaggcgttgctcgagccgcaggcggccatcgagaacgcgagcacggcggcgagggagccggccgcgatcttacgcaggttgttcataatgttccttttctcaacatcatccagacgacagtctggggagtcgggcttggtatgcgcggcattcgcgcggcccgtgaatccaagaaaagaaactatgcgcctaatctgtcctgacactggcgcgcaagtgaattgcgttcgccatttgctgtacgcctgttgaacttaggaaaacttggcatgaattactgacaggtatgggcgatgtgtcaatagcggaaccggcctgcggccgattccgcaccacacttacctcagcacgccctcaatcaatcgcgtgatgagttcggtgtagctcactccggtggcatcccaagccttgggatacatggaaatcggcgtgaagccgggcatggtgttgatttcgttgaccatcaccgtgccatcaggcgtcacgaaggtgtccacacggctcaagccggcaccatccacggccttgaacgcgcgacgggccacgtcacgcacgtcctcaagcacgctgaccggcagattggcaggcacttccacgtggctggcggaggcatccatgtacttggagtcgaaatcgtagaactggtcgtcgttctgatgatcgagcacgatttcgccgggccagctggcctcgggctcgtcaccggccttcgggcacagcacggcacattcgatttcgcgaccatcaatcccctgttcgacgagcaccttccagtcgtgctcgccggcggtggcgatggcggcggccagacgatcctgctgggtctcgcggtcatcggctttctcgactttggtcacaccgaagctggagcctgcgcgcgaaggcttgacaaacagcggataagtaagaccggcgtcctcgatctcggcaagcacatcggcggcggtgaagttgcgcgcatcgaccgtcacaccgggcgcggtgggaatgccggcggcatccagcaccaccttggtgtaatgcttatccatgcaggcggcggaagcaaacactccgcaccccacgtacggcacacccatcatttccagcaggccttgaaccgtaccatcctcgccataggggccgtgcagcaccggcagtaccgcgtccacatgaccaagggaggtcagcacatggtgcatttccgggtcggacatgctgacgaagctggtgccgaagccggaatcggcggaattgatgtggctgggctcgccgatgaagaaaccgtcctgtccgcgagaggggtcaagcatcaccgggcgcgattccggggtgatctttacggtcggcagctcgccgccgtccaagttccagccacgcggatcttcgccattgatgatccacttgccgtccttggtgatgccgaccggaatcggctcgaaccgttcagtgtccatggcccccagcacaccggcagtggagatgcaggaaatcgaatgctcgtctgcacgcccaccatagagcaccacaacacgcttcttggccataaccatccttttgttgaaactacaaccgttttcaagcctatgctttgcaccgccaaccggaccgaaccgcgctcggaacgccgcgcacaagagacgcacaccagtctactcgtgcacgtcaacgacgtatacgccacgcgactttgcacgtacaacgtatacgccacgtatacgtcgcttctctcgttattcgccggtaacctcgtgaccgaacagtccggcaagcatctccgagcaggaaatgccttcgttcagcacgcggctcatctgatacgccaacggggtcggcacatcaagctgatcgccaagagccaccaccgcatccgtggtgggcacgccttcggccacaccgttgctgaccttggtggcctcttcgaccgtcaatcccttgccgagattcgcgccgaacgtatagttacgagacagcgaagagccacaggtggcgatgagatcgcccacaccggccaagccgaagaaggtcttgggatcggcgccagcggctacgcccagcgcggtcagttcggccagtccacgagtttcgatcatggctgcggtgttctcaccgtagccggcaccacgggccatgcccacggccagcgcggtcacgttcttcaggctgccgcacatttccaggccgatgacgtcggtggtcacgaacggcttgaaataggaggtggtgcatgcctcggccaccttcgtggcattatcgaggttcgtgcaagccaccacggtggcggcgggatgacgatcggcgatttccttggacaggttcggtccggaaatggcggcgaaccggtcggccggcaagtcaagggattcgcggacgacttcgtccatacgcttgttggtgccacgctcgatgcccttcatcaggctgacgacgatggcgtgatcgggaatcagtcccttgaattcgacgagtgccactcgcgcgaactgcgcggcgatggccacgactacgatgtccgcgttcttgacggcttcggcgcgatccccagtggcggtcatgttgtccggcaacttttcgacggacggcaggcgcacggcgttgtggtggtgatcgcgaatgccctcgacaatctgctgctccttggcccacatggtcaccgtgttgcctgcgtccgccagcacttggccgaaagcagtaccccatgctcctgcaccgagaaccgttatatttttacccatatcaaattcctaccttcgcttgtcgcgcaacttcatcggcacaatcttgtgccatgctactcgcctaggctccccgtacgggaaccggtgcggctacttctcagccgggaacgggccgccggcttcaggccaaggcttacgactcatactgcggtagtcccagtagccttcagcggggaactgctcgccacgaatttcctccagtactgtgttcatgcgtttgagcacgcgccacatcagctcgttcacggcctcggcaggcggctcttcaccccatgagtccatgtcggcaagcagatcggagtaatcgagcgcatggtcatagcacatcaccacgtttttgcgcggccatggccaccagtggttgatggaggcggcaccccacgtcaccgccgggtacagcggcacctgatgccccagtctgcgcgaggattcaagggcgatatatcccacgccctccttaatgctcatcacccactttttcgggtcgcgggtcacggtgccttccggccagaccgtcagcgggcggccggacgtcagaatatcaatcgaggtctcttcgatctgcttggccttgcccgaatgacgctgcaccggctgcatgccgaccaactggaaccacttgccgatcaatggccacttcgccatctcggccttggccatgtaacgggggcggcggcccatgtggaacaggctcatcattggcacgaacacatcaaacatggtgacatgactggcggcggtgatgaacggtccggtttccggcacctgttccaagccccaggccttggtcttgcagctggcgcggaacacaatggacacccctcccagcagtcgtttggtggccttgggattctgggcgttgatttccggctgattaggcgtgcgggggccggtcgggtaatactgtgtcgagtccacaagcgtgtggcgggcggccagacgcttgacctgctcatcactcagcgggcttacggccgaacgcggcgacggttttcctttggatgccatggtctctattgtggcacggaccaccgcccaacgattccagcgcaacattcccgggaatgcgtcgcacaatacgcggcggcccgtctgcacacaccatgcgcgcagacgggccgccgggaaaacgttcgaatcactccaccgcgatggcgtcaatctccacgagcgcgcccttgggaatcatgttgttgccaaaggccacgcgggcgggcttgacggagccgatgaacacctcagcgtaacgtgcgtccacttccttgaagtcctcgacgttcttcaggtagatggtggcgcggcacacatgctcaatgccggtaccggcagtgtcgagaatgtgcttaatattcttcagcgcctgtgcagcctgctctccagcggtctcgcccgccagttcgccggtggccggatcaatgcccagctggccggatacgaacacgaagccattggccttcaccgcctggctgtatgcgcccagcgcggccggcgcctcggaagtggctacggcttccatcttttcgctcatattgtgctccttctcatcttgggggcgcccacctgctgcggccggcgccggtacacatcaccaccggctacgaccaatcgcacgatcagcaacgattggcaatgccgattacgtagcagtctactgagcaaagtcgcgtttagcgcgcatgatgcccggcatacggccatcaacagactattccttgctattccagacgattccagacgattccagacgattcggctaccgttctcgccaaaccggacggtttttccacgacccaagcgagccggcatcaccggccttgccattgccgacaccagcaccagccttgcacgcgccgaatatgcaaaaggcttccggcggttagccgaaagccatgctggtgggcttgatggggatcgaacccacgaccttctgttccggagacagacgctctatccactgagctacaaacccgagcaacttctttactgtacaccacatcacgttgcatgcggcacatacgtcgccaaaataacgagaaaatcgccattatcggctctacaatggggttatgtcggaacctacagatgacttcgaatacgaacgccgcttcttctgccgcgaactgccggcggaatacgacgacggcgacgccccgaccctcatcattcagagctactacgtgcatgccgacaattacgccttgcgcgtgcggctggtctcgcgcaaggttcacgtcgacatgacgcccgacgtaaatccggtggccgtgctggacgaataccgcgaccggttctcggaagcatatgtcaccgtcaaaggtccgtccgtgggcggcacgcgctacgaagtcgagcgcgaaatcgatacgcgtatcgcggccgaactcatcaagcgcggcggctcggtaatcatcaagaaccggtattccgtgtggattgaggaagacggctggagcgtggatgtgttcggcgggccgaatgcgccgctcatcgtagccgaggccgaacgatccgggccggttaccaatctgacgattccgaaattctgcatcaccgaaatcaccgatcaggcgcgattcaataacgatggtctcgccaaccgtccgttctgtaagtgggcggatgatttcgaggaggagctggcgctggaggggccaaggttccagcagtatttcgggaagaatcggatggtttaggggggggagcaatcgagtacgctcgtgagctcccctcagtcatctacgacgacagcccctctcaaagaggggagccaaaaccacttagtacatgagggtggctaggcgacgacgggcgcgggtcagacgcgggtcggtgggttcggggatggcgaagtattcgagcagacgcttgcgaacctgctcgatatcggccttgtgcccggcggccaaaaagtccagcaaacggtcgaaagcgtcttgaatctggccaccaatcatgtcgatatcagccacggccaactgcgcttccacatcgtccggcgctgcggcggcagcggcacgtacatcacgtacatcagcggccccggagcgggccagcaacagcgccttcgcacgttcgcgggcggccagtgcatcggacgggtcggatccgagcacgcgctcgtattcggcggcggcaccggcgtaatcgccctcctcggccaaacgatgggcttcggcatgctccggcggcacctgctcagcacccgcgacggcaccggtggcaccagcgctcttggcggcatcggaatcaggatcacccgagtacggcgcggtaccgttcacaccagactgcgcggcggcctcaataatcttcggaatcacctcgtcagtaagttgcttgagctcgtcgtcacccggaaggccctgcaacagcggcatcggacggccggcaatcaacgcgaacagtgcgggcacgccctgcacctgcagcgcttgggcaatcgagggattggacgagatatcgatacgggagagctgaatctggccgttcagggcgttcaccgcgtcgcccagtgcacgggccatcgggaacaggcggtcatcggtcggcacccacagaagcagcaggatcgggaaggtcgcagaagtctgcaccattgcctggaaggtgttttcggtggtgtcgatcacgtacccaccagcggcaggcgcgccgcccgcttgtccgggctcggccttgacctgatgcttcagcgcctccaaatcgacggcgcccgccaatgagactcccggattgaactgctgctctgccataatgcctcccgattccacgcgattcgcgtacaacaacaatcacatttgctgacattgattgtaatgccgattcccaccacgtagggattcttccactacgcggtggaattcccaccacgtagcaaaacgcccaccacgatgtgaccccaaacggcaccattatgcgaaaggtaaagttttatcgacatcgtggtggacgaatcacatcgtggtgggggcgttaaccgcgcggtgggtggcggcaacaattacagcgcttcgacctttaccggctgacggtcggcgcccactgcggtgatttgctcaccggaacttgccaacggaatgtacaaggccaccacgttcacatacgtgaccttcatggtgctggtgtacttgtcgctattgaacagcgccttctcgtcgtcggaagccggccgcgattcgcggccatcccctgccttgcgagtccattcgccgttaatacggccaaccaccagatcaccggcaccgtctgcagcacgcatcacccacatctgttcaggcacagcggtgaatttttgctcctgcgtaccgttgttgcgttgcataccttcctgcaccttggccgtggtattggccagttcctggcgcagcaaatcgtctgcgaacttggaagcgtattggctcttggagccgttctgcagcacatcggcgtattgggccaaggcatcggcgggagcggccaccagcttctcatcctttgcggtgcccatctgcgagccaatagtcggaatctcgaacttcggcagcttggcgccctcaaacagtcgagccatagccatcagcttgtaattctgctgggcggattcctgatcgaagaccagcaaacgcttggactgctgatcttcggtggtggtcgtgatggtgaacaccgagcgaggccatccgtcgtccgtaggaatcaccgtctgggcgatgtccttgggaatggtcgcatattcggacataccgccgccacgctgattgatcgtggtctggctgatgcgaatgtccagctggggcccgcccataacggtcgcatacccatcgggattcttggcctgatcggcttcatcgatcgtcttgagaatcttcagacgaatcttcttctcctgcgcctcggtcaaatccggcgcaaccttggtggaggtatcagcagccggcgtcggcagttggccttcacaggcggtcaacggcacgaccaacgccatgcaggcgagggcggacacacacagtttgttccatcgcttgttcatcagctttcctcctgtccgtcatcggccgagtcgtctccggtattgacctcttgggccaagcgggagaagtaggcctgcagttcgtcaggggtgattaccgaagtcgattcgttatcgccggcgctgaggccgggctcagcgccgctttcggcaccggtctgctggtcggcgaccaggttacgcgaacttgggtcgatgataaccggtgtttcggtggcttcagattgcgaggattgcgaggacgcacggcccgaacgccgatgtgtggcgtgacggcgacgattacgtcgacttgcaccatccggcttcccggacactgcgatgctggcgggtgcctcttcctcgattacggcgcttgccatgccttccaccatgcgcttgcggcgcttatgcggcggcatggcgaacacggaggcgcacagtacggccagcacggccagcaatccgccggacagatagaacggcatcgcaaagtccggcacttcggagcgcacccagtgcagctgcaccttggcgttggtgacattttcgcccaaatccacaatggctaccgtcgaggcgccggtcttcttgctcttcagcgaaacggacccagtgccgcatttcacggcagtccacatatcggaatccttgaacgacaccgcgtcatcggcactggtaggcgctccctgactcgtgctgcttcccttctgggtgctcagctcgctccatgatgccaatccggtgatgcgggtataggacttctcggacgcgacccatccggcaacatccttggacgaacccaacgccacgcacgcctcgtcctgagaggatcccgagtccacggttatcgtggcattctgatccaacaaggtcagcacattcggatcagtgacgacataccgggagccgctcatggttgcggaagcggtgatttcagtggagggcttccacatcgtggcattcatgtaccccaacaccacagccgccacggccaatagtccgaagataggcgtcaccactccacgcatgattttggcatgacgggatggacgcttggcgcccttatccggtcttgtagtctgttcttcagcactcataactcaaccattctacaatcttcacctgtttattacctaggagcgcagaaaatcaaggtttaccagtagggtgatgtgtcatgcgtaagtctgttaagtctatgttatctcccctcggcaaggccgttgcccttgcctgctcgctggcgatgtgcgtgtcgctggctgcctgctccagttcgagctcggactcgaaatcctcttccgactcttctgacaagaaggggcaaattgccggcgtgaccgccaagggcaagctcggcgagaagccgaccatctcctttaatacgccgatgaccgtgtccgacggctcctatgtggtgctgcaaaagggcgatggcgacgtaatcgaggagggcgaccgcgtctgcgcccaaggcatcgcgctcaacgttaaagacggcaccgagctcatggacacctggaccaagaacacgccggattgctcgctgaaggtggattccaagaccctctcctcgacctactacaaccagatcaagggtgccaagatcaacaccacgattggctttggcgtcaacgctcaggattcgtccgggtactcttacattctggcgatgacgtttgtgtccaagtccaaggacttggagaaggccactggcgaggaagtcaaggatgtgccggccaatctgccgaaggtgacgcgagccaaaaacggcgagccgtccatcgacatgaacggtcagggttcggttgattcgctgatctcgcagacgctgatcaagggtaacggcgccaagctgaccgacaagaacaccgtggtggtcaagtacaccggttggcttacgaatggcaagcagttcgattcgtcctgggatcgcgattccacaatcgacgccgatctgttcagcgattccagcggccagcatcaggttatcgagggctggcagaagggtctggtcggccagaccgtcggctctcaggttctgctggtgattccgccggatcaggcctatggagataaggagcaaggtccgattcccgccaactccacgttggtcttcgtaatcgatattctcgccgcgtactaaaagatatagcaggggctccctctgatgagggagcccctgctatatctagaacagcctgagactgtcgtcctcggtgcctttcatatcgtcgtaatcgaggatgaggcaggtgaagccgcggtctttggccaagacctgggcttgcggcgtgatggtttgtgcggcgaagatgccgtgcaccggggccagcagcggatctcgattgagcagttcgcagtagcgagtcagctgctcgacgccatcaatgccgccgtgacgtttgatttccacagccacatgctcgccctcggcattcacggccataatatccactgggccaatggcggtcgggtattcgcgacgcaccagcttggctcccttgccgatacgctcgatttgctcggccagatagcgctgcagatggtcttccacgccatccttgatgagacccggatcttcgcccagatcataggtttggtcggaatagatatgctgcagcgtcacttcaagaatgtccgaacccttgtcggcgctgacacgtagcaccttttccggctcaccagcggcgacactttccggggaatgcgtcgcagaatcaccatccacagccccaccagcgacactttcccgggaatgttgcgcggatttggcggctgggtcgatctcacgaatcgtgcagggcgcggtcatccagttcagcggcttgtaggagcccaattcggagaaaatcaacaggctggaatcggccttgatcagcaatacgcgcttggccaggggcagtgaggcgttgaggcggcccgaatactcggccgaacagtcggcaacaataactcgcataggccaccactgtagcgcaacacatggcatacatagcaaaaggggctctctggaaaaccagagagccccttaaggagttggttcaggtcactcggcggtgccggagtactggacgtcgtggccgcgctcgaccgccacggtgagtttgttcgagtcgaaggaaatgaatccgtcggtcacctcgaacatgtggcgatcgccatcgggctcaaccacggtgagcgtaccctgcttgatcaccgtgagcacaggctcatggtcgggcaggatgcccatgccgccctcagaggcgggaatggtcacgctcgtcgcctcgccgtgccacacagggtggtcagcggcgacgatgttgaccttcatcgtggttttttccgcagccatcacgcacccagttccttctgcatgttgtgccacttctcttcgaggtcgtcgatgccgccgatgccggagaacgcctgctccgggacgtcgtcgtacacgccgtcgcagatgcgggtgaaggcttcgatggtctcgtcggccggcacgtaggagccggggcgaccggtgaacttctcagccacatagaagttctggccgaggaactgctcgatcttacgagcacggttcacggtggtcttgtcctcttcgccgagctcgtcgataccgatcagggcgatgatgtcctgcagctccttgttacgctgcagaatcgccttgacgcggttggcgcagtcgtagtgagcctggcccacgtaacgcggatcgaggattcgcgaggtggagctcagcgggtccacagccgggtagatacccttggaggcaatgtcacgagaaagctcggtggttgcatccaagtgggcgaaggtcgtggccggggccgggtcggtgtaatcatcggccggcacgtaaatggcctgcaacgaggtgatcgagtgaccacgggtcgaggtgatgcgctcctggagggaacccatctcatcggccaggttcggctggtaccccacggcggaaggcatacgacccagcagggtggacacctcggaaccggcctgggtgaagcggaagatgttgtcgatgaacagcagcacgtcctggttctgcacgtcacggaagtactctgccatggtcagtgcggtcagcgggacacgcagacgggtacccggctgctcatccatctggccgaagaccagtgcggtcttctcaagcacgccggcctcggccatttcgccgatcagatcgttaccctcacgggtacgctcgccgacgccagcgaacacggacacaccaccgtggttctgggccacgcgctgaatcatttcctgaatcagcacggtcttgcccacacctgcaccaccgaacagaccgatcttgccgccctgcacgtacggggtcagcagatcgatgaccttgatgcccgtttcgaacatctgggtcttggactccagctgatcgaaggccggcgggttgcggtggataggccaacgctcggagacggtgatggtctcatccggcttcttgttgaggatgttaccggacacgtcgaagacgtggcccttggtcacgtcgccgaccggcacggagatcggggcgccggtgtcggagacggaggcaccacgaaccaggccgtcggtgggcttcagagcgacgcaacggaccgtggaatcaccgaggtgctgttcgacctcgagggtgatctcggtctccttcgcctcgccttcttccttggcgctggtgttgacgatcgttactttcagggcgttgtagatgtcgggcagatgacccaccgggaattcaacgtcgataaccgagccctggacgcgggtgacgcgaccgttggtaggctcggccgcagtggtctggttgtcagccatatgcgttcctactcttccttcttggtcagcgcgtcagcgctgccgatgatttcggtaagttcctgggtgatcgaggcctggcgggaagcgttgagcttgcgcgtaaggtcgtcgatcaggtttcgtgcgttgtcggttgccgtgtgcatggcgttctggcggcttgcggtttccgacgcggccgcggtcagcaggcactcgtggatacgggactgaatgtacttcggcagaatcgcatccagtaccttttcgaggctgggctcgaaagtgtacagcggagcgacatccgcagtagccggtgcctcttcatcaggatcgggcaccttggtctcgtttttcacgatttcgaccggcagcatgcgcagcacgcgcaccttctgcaccaccatgttgatgaactcggtgtagacgatgtagagttcggaaactccacccttctcagccggcttcatgtaggcgtccatcaaggtgttggagatcgtttcagcaatttccacgccgggctggtcggtgtcgccttcccacgtcgccgcgatgtcacgattacggtacttgtagtacgtcgaaccgcgacgcccgtacacgaacagctccggctgcttgcctgccgcatcgaggcgggacagcagcgactccgtttcacggataatcgaagaggtgtacgggccggccataccacgatccgaggtgagggcgagaacagccacgcgcgggttcttctcgtccttcaccgcgatcggatgcgtgatatgggtgtgggccaccaacgcttgcacggcatcgaaaatcgcatcggtgtacggcttcgcgttcagggccacatcacgggccttggcgatatgcgaagacgcgatcatctcctgagcgttgaagatcttcgccaacgactcggtggagcggatgcgtgatttcaatgcgagttgcgagcccatggcttacttttctcccgccacgatcttttcctgatcgaccggcgcggccttgtcaacgtccggcttcttctcgaccagcggcttgccggcggaagagacgaacgtcgaacggaactcgtccacggccttatcgagggcagcctcggtgtcggcggtgaattcctcggtctcgcgaatggtcttgaggatatcggtgttgtggtcgatgtagtccagcagtccctgctcgaacggaaggacgtccttcaggtcgaggtcgtcgagcttgccgtgggtgccggtccatacggacacgacttcctgttccggcgagtacgggtggaactgcggctgcttcaacagctcggtcaggtgggcaccacgggtcaactgggccttggaagccgcatccagatcggaggcgaacatggcgaaggattccagcgaacggtactgtgccagggagatcttcagcgtaccggagaccttcttcagagccttggtctgtgcggcgccaccgactcgagagacggagataccgacgtccacggcggggcgctggttggcgttgaacagatcggactgcaggaagatctggccgtcagtgatggagatcacgttggtcgggatgtaggcggacacatcgttcgccttggtctcgacgatcggcagacccgtcatcgaaccgccgcccaggtcatcggagaccttggcgcaacgttcgagcaggcgggagtgcaggtagaacacatcacccgggtaggcttcacgccccggcgggcggcgcagcagcagggaaatcgaacgataggcctctgcctgcttggacaagtcatcgaagacgatgagcacatgcttgccgttgtacatccagtgctggccgatggccgagccggtgtacggggcgatgtacttgaagccagcggaatcggctgccggggaggccacgatggtggtgtactccatggcgccggcgtcttccaggctctgcttcaccgaggcgatggtggagcccttctggccgatggccacgtagatgcagcggacctgcttcttcgggtcgccggattcccagttggccttctggttgatgatggtatcgatcgcgatggcggtcttaccggtctggcggtcgccgatgatgagctggcgctggccgcggccgatcggggtcatcgcgtcgatggccttgaggccggtggacagcggctcgtcgaccgggtggcggtgcatcacgtcgggggcctgggcttcgaggatacgacgaccctcaatgccctgaatctcgccgaggccgtcgagcggcttgcccagcgggtccacgacgcggccgagatagccgtcgccgacgggcacggaaagcacttcgccggtgcgtcgcacttcctggccttcctcaattccagcgaaatcgccgaggatcaccacgccgatctcacgggcgtcaaggttgaacgccaggccgagcgtgccgtcttcgaacgtcagcagctcattggccatgcaaccaggcaatcccgtcacgtgtgcaatgccgtcaccggccgtggcgacatagcccacttcctgggtgggggtgtcgctcggcttgtacgacgacacgaagtcgtcgagggccttgcgaatcgaggcgggatcgatggtcagttctgccatgatcactccttctattggttattgttcagtcaagtctttgcttgtgtgtggtgttggacggattggctcggccggtcaggccggagtcgcctccgtctgcaccttgcgatgcaagttctgcagctgtgcgaccacggtgttgtccgtgacttcgtcgcccacctggatgcgcatgccacccagcacggtcgggtcgaccaccgagttgatgtgcacctgacggcccaccttggcggagtagacctcgaccagtcgcttgatctgctccttcttcagcggggtggcggtggtcacggtgaccatcgactcgcccatgtggcgggagaacttgttgatcagccactggatggtctccaagtagcggcggcggcgcaggttgcaagtggcgtgttcggcgagcctcatggtgaccttgttcagggtcttgccagagaacacctcgcggaacagcttcacacgggcctcgctggtggcctggtagtcgtacagcttggcgcgtacgaccggcaggttcagcagtgcggaatgcagctcggacagctcgatggatacctgcagcgtggcgtcagtggcgtccgcgtagtacatcatggcgtccacgccgaagtcttccactgcgttggcgatgtcgcgcgcacggctccaacggcgggagaccaagtcagtcatgatctccatggtcatcggatgcgcgttgtcaccgagcagttccttcaggacggccaccttgtcggcaaccgggcgggacgggtcggtcagtgcgcgctccagctgaatgctgtcatcgaacaccttggtgatcgtgaacagttcgttgccgatccgccacgcgtcctcacgggtgtcgcgcagtttcggggccagcgaatcacgcgactcgcggtctgcaatacgtgatgcctctcctcgcatggtcacctccctttctggttacggatggtcacggtcacttcttggcgcccaggtcgtcgatcatcgaatcgatcatcgaggactgcacgtcgttgtcttccagcttggcaccgaggatcttgccggccagggcggtggcaagtgcgccgacctcgcccttgagcgagacgatggcctgctggtgctgggattcgatcgagcgctgtgcggatgcggtgatctgggccgcatcggactcggcgcgggaacgagcgtcggcgatgatgtgggacgcttccgcacgggcgtcgtcgcgaatcttggcggcgtccacacgggcggtgctcagctgggcctcatacttggccttggcctcgtcggcgtccttcctagcctgctccgccttggcgatgttgccctgaatcttggcggcgcgctcgtcgaagatcgcattgaacttcggcatgaagaacttgtagaagaacaccgcaacgatgacaagaatgatcagcgaccatacgatgtcataaacctcaggaatgaacaggtcaatcccgcttgctgcttgtgtcatcaagccctcctttcagtgatggacataatcggttttcgtctgttgatctgcgcagatcagatgatcagggcggcgacgaagccgatcagtgccagcacctcgaccagagccaggccgatgaacatgatggtctggatcttgccggacatctcaggctgacgagcggtggattccatggccttgccgaagaggatgcccagaccaatgccagggccaagagtaccgataccgtaaccgatgacggacaggttgccggcgacctctgcgagggtgatgatatccattgtgtttcctttctaacgtacttggcgacgttataaatcttggggtttggtcggtctgcgattttcccagaccggggaccggaagcggcgggttagtcgcccgtcactcttccgggaagctcaggttgatgtacacggtggaaagaatcgcgaagacgtaggcttgcaggaaggcgacgaacgcctcgaagcaggtcatggcgaaaccaccggcgaaccacagcgcacccaccgggatgccctgcagcttgttgaccgcgtcaaccatccagaactgtgcgaacgccagacaggtggcgaccataaggtggccggaaaccatgttggcgaacagacggatggtcagggaggccgggcggatgatcaacagctcaagcaggttgatcggagccagcaggaaatagaccggccacggcacaccgggggtgaacagctcgtggcgcagatagtggccgaggccctgcgagcggatggcggcgatccagtactggatcagtgtccagacagcgaacacgagcggcatgaccaccgtggcgttggccgccatgttcatacctggaatgatgccgcacaggttgaaaatgaagatcgtgaagaacagggtggtgatcatcggcacgtagcgcttgccacgggcctcacccatcacgtcatacacgaccttgtcgcgcacgaagtcgagaccgtactcgactacgccctgccaacggccggggatgagcttggcgcgctttgcggtcacgccgagcaccaccaacagcacgatggttgccacgatacgaatcaaaataatgcggttgatggcaaacggagttccctggaacagaatctccgggggaaggaagtcatcaaccgagggcagatgagcgcctgcctcgtcagccaacagcaatcctgcgctgagcgaaccgaccatatcacgcctcctgcttcttcaatgtcaggtgtcagtttaaacccaccgggcaggcaaatgtgacgtgctcgttactttcgtctttttttgtctcctcggtgtggagtctgccgggcatggacacggagtctgcgctgggcattcggctccgaatgactgaagagtgattatttgcctgcgtctagacaatgtcaatattataccggcgagtctcctgaaatccctactgctgcaaggttttcccgggcgtttcgcgaacgttgtgcactattggtcgcattacgcggatgtgtggcattacgttcatcaagccgtccacatcgtggacgaacaaccgtccacgctacgaacgcaacctccaacagtagctccctctgatgggccgagccgtgaaggagaagcaaaggagctccccgtcgaggggagctgtcgtcgtaggcgactgaggggagatcgtaggctcagccctgaatcaccccatacccgtcatgcacaaacggcttgaaatcatcctggcgcggcccgcccggctcatgccgaatcgaacgatcagtaccgagcttcttctcagccctgagctgcggcacctcggtcaggtcatacggcgtggtctggtacacccagttgagccagttgcgccacagcagattggcgtgggcgcgccaggcgaacaacggttccagcttcggatcgtcatgcgggaagtagttcttcgggaagggcacgttggtcatgcccttggccatatcgcgctcgtattcctcggcgagcgtgtacttgccgtactcccaatggccgagcgcgaacacttcggagaagtcacgcgtggcgatcaggcccgggccggactgcggcccccaagtcaagatctgaaggtcatggttggcacgtacctcgttttcgttcacgccggcgaggcgggagtgcggctgcagatcaatctcgtcgaagccattggtcaagaagcagtattcgtcctgcaggtactgcgggaatacgccgaaaatcttctcggggtaatccaccttgtggatgccgtaacggtagtacagtgcgcccatcgcaccccagcacaggtacatggtggagaacacatgggtggaggcccagtcgagaatcgtcttgaactcgtcccagtagtccacatcttcgaacggcatatgctctacaggcgcgccggtgaccacaaaaccgtcgtaatagttgtctttgaacgcatcgaggttttcgtagaacttgacgagatgatcggcggaaacgtgcgtggcctcatgcgtggaggtcttcatgaagtcgatttcgacctgcagcggcgacttggaaatcagacgcagcagctgtgtttcagtctcgattttcttaggcatcaagttcaggatcaccagtttgagcgggcggacgcgctgacgctccgcctcgggcttctccagagcgaagatgcgctccgaatcgaggatatctctggccggcaggccactggggatcttgataggcatgttcctattatgtcaatattcgggataacggttcagggcattcctataacggccatttatggcgcgttattaccccgactccgactccgccccaaacccctcgctgcgtgagccaattcacgttttaaaaccgcgggaagatgacgcgacacgccgatgttgactttctgaaatctgcacctattgtagatagagctgtctgagagacaagccgacgcggggtggagcagctcggtagctcgctgggctcataacccagaggtccatggttcaaatccatgccccgctacgaacgtggttatatggccgctgatttcggtaccgaaatcagcggcctttccgtttaccgtggcgatatggatgaaaggcgatcaggcagctacggtgcccagggaagtcggcgatcataaacgtctcgtcattttcatcgcggatcttcagttgtctaatccacgggaggcgacaggcgtgaagtttctcaacgaagcggaagccgggcacaagtcgtatgttacgatcgacttcgtgcccagctcccgttcttctgctcagaagcggagtgtggttcaccatccagccgacatcatcggcatcatgccgcagcgggtcaacgtatcggccagcgcatcgtccagtgcttgaatcggtcatagcgacgacgccaccgaacgacgatggacagtatggcgcctatcgccagagctgacacggccagaaccgaggcaagcgacacatcgccacccgtgacgggcagtgacgggcgagggttgggcgtggttgcctccgccggcgccggcggcgtctcgggtttctccggttcgcacggtttctccgactcgcatgggggcaacacccgcacacgctcccaggcatcgtcataccggctggacgccggggaaacacggtcatccccctcgaaccgccagacgaacacgtaccacccaggccgttcggcggtcagatacataggagcgccatgcgcgtccaacgccccggcgccgattttgaacgtgccgttcatcgcgggaatctcccaggtggccagcaaccggtggttgtcgtcttccgtgggaacctctcccccagatggcttgtacgcctcatcgttggaggggttgtcgggatcgccggaccaccatacgctcaccgtcgcatacggccgatccgccgcgaactcatactcttcgttgccggcatactggccatgatccgcagggaatcccgatacggtaatggtgtcgctgagctcggcaccgatatccgccgaatgctcagtgaccgtcgacatgacttctagcttcctgcgacttgtattgctttccgtagcctccataaacggacttatccagtcgcctataaggtattcctgcgcctgtttgctctgctcggaccgccgaaacacccatacccatgtgccaaaaccgctattctgcttggtccggtaagcggcaccgtcatccggcttggtcatggcctgcacacgtgcctgctgccccaccccggtgaaagaggccttgccataggccaccggctcataacccaaagtcgccaatcgcgcaagaaaagcatcggcgctctcttgtgcattcggcgtaatgacattgcccacatcgcccgtatcaagaccatcgaaatagtatccgcgggcctgcaattccaaatcgggcacccaataactgtccgcatccgccacgccactggtcacgtcatcgaacaccggagaagccacatcaagcaccttctcggagaccttggtggataccgccggaacaaaatccttacgcacccgaaatgtcgtcgacgcgccgccagtggaagccatcgagtcaaaggccagcatgtcctgagtgctgtccatgacgtgcatccgcccatactcgtatgtggtgttcgccgtcacctcgccggcgccggtcgcctcccacgcgatcgaggacccggcgctcgtcgacacccccgagaacgtgttgccgccttggacgaaccgcgccgccccctgcaaggtgacggtgaacggcactcccgcgatcgcgtcaccggcgcggttcaccactttcaccgagatggaaccgctgcgcaaagcctcggcatcggtgcgttccaccgtcgtgcccgcaggcgtcttgccggccgattgatcccatatccgggccgccttcgccacgatctcggggtaccggccttgaatgaccgccatctgtctcgcccactcgtcccgatcgcgcccgaagtgatcctgcacgatgatgccgatcgccgcatgggtggcggcatccgtgtcgcggtaccggtcaaggatccatgccatacgccgggcgttctcatcggaggcaagcaccgtggtggggcctatcacatagtcgctcagtttccccgcttcgatgcagtagtacttgttgcccgaagcgtccagccccgcgacaccgacgtaatattccatatcgttgtatggaaacgccacgtgatatctttcgtcggcgggcgtcaacgtcgcggcatacgccgtattcgccgagccgaacaccactcccaccattattatcagaccggtcagcatcgctacgatggccatgccccgttgccgccatgtcgttatcatcattcgtcctttcctggtacgtttccccgcatactgcactgtgtgcgggtaggccacgatcatggcagattttcattcgctacagccggtttttcgacctatgtggtccgagcttgccgtttgccggcgagttgtggataactcttccgccgagttatccacctcatgcggttgaccgaacgtttacctgatagttatccacaatgcgcaacatatgttcaaaagcccttagaatagggccttatggcagcagtacaacatcgcgcgaccacgcgcactagtaataccgataacagcaccacgaaaacgaagtcaaaggcgacttctgcccgaaagagccccgcaaccaagcgcaagagagtcagcgccgaaacggcacgcgccgcagcagcgctgaaaggcctggctgtcgaagcccccgcaccgtccatcgaagcaaacgagcccggccagttcggccgcatcaatgtcatggacatcactcccgccgaggagcgcggcatcttccccgcccgtgtggaactcggcgaaccgtttgagatgaccgcccaggtgttcatcgaaggccgtaccaaggtgggtgccaccgccatcgtgcgcaacccgcgcggcaaggaaaccatgcgccgggccatgacctgcgtaaatcccggcctcgatcgttggaccgtgatggtcaagtgcggcgagcacagcgatctgaagccttgggaggatggctacgcggccgtcaagcgtcagctcggcgaatggaccgtgaccatcgaaggttgggaagacgcgtacgtctcctggctgcacgacgcccgcatcaaggtgcgtgtgatggacgacgtggacaacgcactcaattccggtgccgagttgctggcccgttgggccgaaaccccggacaccggcctgaccgcacgcgatcgcaagaccttggagaaggccgctgagaccatggccgatcagacgctgagcgccgaggatcgtctcgccgccggcgacaacccgaccatcgccgccctgcacgagactcacccgctgcgcgacggcatctcccccagccagccccagcgcttcaaggtggaacgcccgaagtccagcttcgcggcttggtaccagttcttcccgcgttccgaaggcgccaccatcgatccgaacaccggcaagatcattcagggtacgctgaagacttcgatggccggcctcgaacgcgccgctgccgagggcttcgacatcgtctacctgccgccggtcttcccgattggcgtgaccaaccgcaagggccgcaacaacacgctggtcgccggccccgatgacccgggctccccgttcggcatcggctccgagctaggtggccacgacaccgtggatccactgctcggcaccatggacgatttcaaggccctgtgccagcgtgcacatgaactgggtctggaaatcgcgcttgatttcgccctgcagtgctcgcccgatcacccgtgggtcaaggcccacccgaactggttccgccacaagccggacggctccatcgccttcgccgagaacccgccgaagaagtatcaggacatctacccgatcgacttcaacgccgacatgcccggcatcgaaaaagaagtcgaacgcatcatgaatctgtggatcgaggcgggcgtcaccatcttccgcatcgataacccgcacaccaagccggtgcgtttctggcaggacgtgattgccgccgtgaccaagaagcacccggagatcctgttcctggccgaggcattcacccgcccgggcatgatgcgcgccctgagctacgtgggcttcacccagtcccactgctacttcccgtggcgcaacaccaaggacgaactggaagagtatctgccggtcaccaatggcgacgacggctactaccagcacaacaccttctggcccaccacgccggatattctcaccgcttacgtgcgagacaacggcgtagccggccactgcgtgcgtgcggtgctggcagccatgggctcgccgtcctggggtatctacaacggttacgaactcatcgagaacaagcagcgccccggcttcgaagagcagatcgacaacgagaagtacgaggtcaaggttcgcgattggagcaaggccaagcagtacggcgtggccgagatgctcaccgcactcaacaagattcgtcgcgcccacccggccgcgttgagctaccacaacctcaccgtgctgcctacgtccgacccgaatattctggctttcgcacgccacacgccggccgaactgaccggtaccggccaagcggacacgctgattgtggtcgtgaacctcgatggacacaacgcacaccagtcgatgattcacctagaactcagcgagctgggtctgcccaccgaccgcccgctcaacgtgcgcgacgagctgaccggccgcgaattccagtggggttgggacaactacgtgtctctggctccttgggcggatgtggcccacatcctgtccgtgcagtgatgcggtactgcaacggtaatgcaacagtgatgccgttgacgtgcatgggtttatcgtgcgcgtaaaccgctagaaatcctcccctcaaggggaggatttcgtctgtttgggcatagtgtcggcataatctcagcacggtttcttgagttccgcacctgttttgcaggcgtaaacagggtattgtggtgagacgataacgtaactgtcgattttcaaggagaaatgacatggcagaaaccttcaacgtcgttgtggaaattccgcgcggctccaagaacaagtacgaagtcgatcacgagaccggtcgcgtcttcctggaccgtaccctgttcaccgcaatgggttacccggatgactacggctacatcgacggcaccctgggcgaggacggcgatccgctggacgctctcgtgatgattccgaactccgtgttcccgggctgcgtggtcgagtgccgcgccgtgggcctgtaccacatggtcgacgaggccggcggcgacgacaaggtgctgtgcgtgcccgccgacgttcgtttcgatgacatcaaggacatcgacgacgtcaacgagtaccacaaggccgaaatcaagcacttcttcgagcagtacaaggctctggagccgggcaaggaagtcctgccgggcgactactggactggtgctgacgccgccgaaaaggaaatcattgccgcgcgtcagcgtctcgccgattccgagaagtgattcgattctgaatcgttgacaggaggccccttcgggggccttttgttgtatttgtggcaaagccgctctactctccctcagtcgcagtttcactgcgccagctccccaacagagggagcttgtattttgtgatacagtaatgttttgtcttttcaactaggcgtaggcggcgtgtaggaacgctggtcgaggcccatcgcacggtaatccggcgatgaaccttttgtcacaccatgatttcgataatcattcaaatcctgcttatttctgtttccgtagctatggatgcattcgccgtatccattggcaaaggcctgaccgtatcccgcgtacgagtacaagacgccgtgaaaagcaccctctggttcggcggattccagatgctgttccctattctcggctatttcgcggcatctacattcagcaaatacgtaacccaattcgaccattggatcatcttcgccctgttggtgttcatcggcggcaacatggttcacgaagccttcgaagaagatgaggaaaactccaaggagaccgcccagttcgattggaagcatatgcttcccctggccgtggcctgcagcatcgatgcgttcgccgtgggcgtgagcctggccttcatgttcaccaaagcccatatggcattcgccatcctcagcatcggtgtggtcaccggactgttctccgctgcgggcctgcacattggccgcgcgttcggttcccgctggcagaagccggcgcagatcgccggcggcgtggtgctgattctactcggcatcaaagtgctattggagcatttgggcgttatcgcgttctgatttagtgtcataagccccttcaccagaaagggctattttgtttgatttcaccgttccaatgcccgacgtaggattgggatggaaattcgattatctgagaggcgtatcatgaccgagatcacccaggagggttggaagaacaaagccctgagcatgttgttggcccaactgacgtcctatgtactgctcatcgcagccacggtcattccctcccctggcaccgtccccatcatccctttgattatcgccgctctgacgttggccgcatttgtcgtattctggccgttccgcggcagcatactggatcgtatcgtcactttggtgtttggcgcgatttctctgattttcgtcatcgtacctttcccgaccagcgaggttccgccggatcagaccgctgcggatggctcggtacttccttggtattcatgggcactggccatgggcctgctgctggtggtgctggtggtcttctccttcggacgccagatggctcgtgagaagcgcgaacatcttatccgcgcactctctcacgccgtgacttccggtgtggcagctctcgccgtggccggctggtgcttcctacctgatttgggcgcgatgctcgccaagggcaccgttgcgggaaccgttgccctgatcatcctcatcgttttgggactggctttggccgtggcttccacgttgtgggtgcgcgacgccgatccggacccggatatccgttatccgtggatcggtaccggcctgatgccggtaatgctgatgggcgtgaccatcgccgcaaccgcactggtgctcggccgtatcatcggttgatggacgtccaccgttccatattccgcaaacttgtaacctatgtgtccactacaagcgcgtagaataatgaaaaccgtgcgaaagcggcataacgccgctgacgactcgtacagccacaccgagcaattgcgtaacacattgcaggataagggggattagcgtgacggatcttacgttgatgactttcgccagcgaccccgccaccgttttgccatcactcgccctgctttctcatcgcgtccgcgtactgccgatggatgcagccagcttggtgaagatgccggagaacaccattctgtttctggatgcacgcgatgatctggcgaccgccaaaaccttgtgccgcctcatccacgcttccggcctgtccacgccaatcgtgctggtgctgaccgaaggcggcttcaccgtggtcaactcccagtggggcattgcggatgtggtggtcgccaccgcttccccggccgaagtcgagggccgattgcgattggtctccgagcgcggcaacgctcccgcagccgcagcagccggttctcccgccgaatccaccaccacggtggaagatggccagattcgctccggcgacctcattgtggacaccaacggctataccgcctccctgcatggacgccccatcgatctggcatacaaggagttcgaactcctcaagtacttggtccagcaccccggccgcgtgttcacgcgcgcccagttgctgcaggaagtatggggctacgactactacggtggcactcgtacggtcgacgtgcatatccgtcgtctgcgcgccaagctcggcggcgaatacgaacacctcatcggcaccgtgcgcaacgtgggctaccgattcgacccgccggagacggataaggaaactgccgccgcacagcaggccgccaaagcatcctctgccgccatcgacaccgatgacgatactcccgatctcaacaccgtcgcctgacagaccagcggcgctgcaaactatcaatcatcgatattacgccgcttaggtccatacgatgagagaaaccaaatccgcgcgtctcacgcgcatgcatgacgaatacgacattctgcgccaggtgattccggcacccgcttgcgcactgcatttctcgaatccgctcgaattgctgatcgccaccgtgctcagcgcccagaccaccgacaagcgtgtcaacacggtcaccccggaactgttcgccacctaccccaccgcccgtgacttggcggccgcaaacccggcccaagtcgaagacatcattcatccactggggttctatcgttcgaaaacccagcatctcatcggactggccacggcactggacgaacgattcggcggcgtggtgccgcgcacgatggatgaactgaccagcttgccgggggtcggccgcaaaaccgcgaacgtcgtgctcggcaacgcgttcgatatccccggattcccggtcgatacgcatgtgatgcgcgtaaccggacgactgcgttggcggtcggattggcggtccgcacaccccgatcccgtgaaaatcgagaaggaaatcacctcctgttttccgcccgaagagtggacgaatctcagccaccgactgattctgttcggccgggccacctgccacgcacgtacccctgactgcgccaactgcccgctgtccgacacctgccctagctatgcgccgcccgccggcaagagcacgtccaagcgctaactcatacctcatcatggtgaattgcggattctaggctgaatccaccgctagactgaaaaccatgcagcacagcaagcgggacaatacatggtccaagtgggggatttttctcggagtcgccgtggcactcggcgcactcgtggttgtgggatggacgttcatgcaaaaccggttccagccgggatcatccctcgatgccgatgtgaccattggcatcgacgatatgccgcaatccttggatattcggtccgattcctctgcggcagccgaacgcctgctcgtcgacaatgtgtatgagacattagtgaccgtcgatcaagacaacaagcttcagccgggactggcgacaagctggaagacttccgatgacggactgaccgtcaccctgacactgcaatcgggcgtcaccttctcgaacggccatacgttggacgcctcggacgccgtgtggtcgttgcaacagaacgtgaccaacaaggtggcggacgtcgacgaattgggcgatctggcgtcggtcgccaatccgaacgccaccacggtggtcattacgcttgccaagcccaatccgacgctgctgcgagcgctgtccggcagactcggcattgtctacgattccgagtcgtccagtgccgattatcaacgcaaggccataggttccggaccattcaccgtggccgatttccagcctggccattccctgaagctggcgcgcagcgatacctaccatggcaccaaagcggccagcaatgtcgttgaatttatgcaatactccgacgccgatgcgctcagcaaggccctgaccgacggcagtctcgatatggcggcaccggtttcggcttcgacggccaccggtttgaacggcaaggatggcctgaccgtcaaggagggggccactacggataaggtgctgctggcctacaacaacggcaccgattcgctgctctccgacgaacaggcgcgtaaagccttccgctatcaaatcgacgcagccggcatcgcctccgcccaacccgacgcagccggagcattgggcggccccatcagcctgctggaacccggatacgaagatttgaccggactgtacccgcatgacgaaaaccaagctgggcagatgttctcctactttggtgcgcaatacctgactacggtgaatctggtggttcccgaagaataccggtcgttggccgaaaccatcaagcagcagatcgagcggcagccgcgccccacggtgaaccttgaagtgctctccgatgaggattatgccaaacgaatcaaggacggcaaatgggaactgaccgtgatgagcatggacggcacggatgatgccggcatattcgccgaccccgattccatgttccattacgaccataccgaagcgcaacaggcctatgcggatgctcgcgccgccactaatgacgccgattatgaggcacgaatgaaggcgtacgcccggctgatcagcgaggatgcggccagtgattggctgtatacccgcaaatgcttcactgtggcgtccaccaaggtctccggctacccgacctcgatgatcaatcgccgcatgccgctggccgggttgacggtgaagtaggcaaccttcagtcacggacgggctacgcccgatagtccttggctcactatcgttcgatcgttcgtacctcgcctgcgaacagcctactgggctgtttactgtacagttcggcttgtcatgcaacgtgcataaactttggccttatgactgaaggcaaatccatcatcaacgccaacctcaccccgctgcccgacaaggtcggcgtggacggacttgaggacaagtggcgcaccgtctgggatgaagacggcacctacaaattccgcaacacccgcgaccgcaaggccgtctactccatcgacaccccgccacccaccgtctccggttcgctgcacgtgggtcacgtgttctcttacacgcacaccgatgtgattgcgcgctacaagcgcatgcgcggctacgacgtgttctacccgatgggttgggatgacaacggcctgcctaccgagcgccgcgtgcagaactactatggcgtgcgcgtggacgtgtctctgccttacgacccggacttcaagccgccgtttgaaggcactgatggcaagaagattgacgccaaggatcaggtgccgatttcccgcaagaacttcatcgagctgtgcgagcgtctgactgctcaggatgagaagctgtttgaggccctgtggcgcaagctgggtctgtccatcgactggtcgcagacctaccacaccatcggtcagcacccgcagcgtgtggcccagaaggccttcctgcgcaacctcgcccgtggcgaggcctaccagcaggacgcccccggcctgtgggatgtgaccttccagaccgccgtggcccaggccgagctcgaatcgcgcgaataccccggcttctaccacaaggtggccttccgctttgaggacggcaccccgatctacatcgagaccacccgccccgaactgctggcggcctgcacctcgctgatcgccaacccgaacgacgaacgctacaagcagtacttcggccagtacgtctactcccctctgttcaaggtcaaggtgccgattctggcgcacccggccgccgaaatggacaagggtgccggtatcgccatgtgctgtacgttcggtgatgtaaccgacgtcgagtggtggcgcgacctgaagctgcccacccgcccgatcatccagcgcaacggccgtatcgtgatggataccccggactggatcgaggacccggccggccgcgaggtctttgccgaaaccgctggcaagaccacgttctccgcccgcaagatcatcgtcgacaagctgcgcgagtccggcgatctggacggcgagccgaccccgaccaagcgtatgacgaacttctacgagaagggcgacaagccgctcgagatcgtcacctcccgccagtggtatttgaagaacggcggtaccgacgccaagctgaacgccgagcttatcgagcgtggcaaggaactcgagttccaccccgacttcatgcgcgtgcgttatgagaactgggtgcacggcctgaacggcgactggctgatctcccgtcagcgcttcttcggcgtcccgttcccgctgtggtacccggtgaacgcttccggcgagccggattacgatcacccgatcactccgtccgaggatcgtctgccgatcgacccgaccatcgacgtgccggagggctacgacgagtcccagcgtgatgtgcccggtggtttcaccgccgaaaaggacatcatggacacctgggccacctcttcgctgaccccgcagatcgtgacccactgggccgagccggacgaggcctccaaggccctgttcgcttccaccttcccgatggacctgcgcccgcagggtcaggacatcatccgcacctggctgttctcgactgtggaccgcgcgcacttggagaacaagtgcctgccgtgggcccatgccacgctgtccggctggattctggaccccgaccacaagaagatgtcgaagtccaagggcaacgtcgtggtgccgaacgagccgatcgagaagttcggcgcggacgccgtgcgttactgggccgccgccgctcgcctaggcctcgatgccacgtacgacatcggccagatgaagattggccgtcgactggccatcaagctgctgaacgccaccaagttcgcgctggccatcggccgtgaggacgagaaccatcacgtgggcgctgccgccgaggccgcgtggaacccggccgatgtgaccgaaccgctggatcgcgccgctatggccaagctggctttggtggtgcgtcaggccaccgaggcgctggaatcctacgagcattccaaggcgctggaagtcatcgagtcctacttctggcagttctgcgacgactacatcgagctggtcaagaaccgcgcctatggcactccggacgagcacggcaatgtgccgtccgagaaggctgtgaagtccgcccgcaccgctctgggtctgggcctggacgccttcgcacgtctgctggccccgtacctgccgtacgccaccgaggaagtgtggagctggatgcacgccggttccggttccgtgcatcgcgccgcctggccggtcgtggacccgtatgtcgaggccgccaccggtgcttcccccgagctgctgacttgggccggcaaggccgtggagcagctgcgtaagatcaagtccgaggccaaggtctccatgaagaccccaatcctgtctgtggcactgtccgctgcttcggaaggtgtggaagcgattcacgccgccttgggcgatatcgcgcaggccggtcgcgtggtcggcaagttcgacttggtggccaagcacgccgaggaatccgccgccgaaggcacgcccgaaaccgaggtcgccgtcgaagccagcgagctcggtgagccgccagctaagaagccaaagcactgaacgttacgcacaacaacagtaggtctcacggcaatgccgctcgttccgagcctacgggaagcccaccgggcttcccgcttaacggctcggccagctaagaagccaaagcactgaacgttacgcacaacaacaaaagaggggaacctattgaggttcccctcttttgttttttgacgttcggatgacacgactgtgggacggcacgcaaatatcccgcatacaccatcacaccgtcggaatcacgatgagatatcgggtttcggcggttttttgttgcgtattggggctgtcgagctgcgcgacggcctgcgccaagagcgtgccagcatcactgattttcacggtctcattaatcagcgcgttcatatcgtgcttgaacagcgtgccgccagtgccaaagccgaacagtactggagcggtgtcaagattgttgccggaatcgctggcgttggaggccttgccgttgccggaatcgccagtgtcgctcgacttggctgagtcgttcgttcccgaaccagcgctcttagacgagtcggacttatcaccaccaccgatggccgaagtaagaccacccgcatagttcatcacatcgccagcagacatggacatggtgtcatcgaccagtgaggccttggaatgctgcgactgctgctgttgcgcggctttggcctgcttacgggcggcatcggccttacgcttggcttgggcgacccgggtcttgccgtagaacgattgcgattgcgaatcgaccaggccggtcagtgcctgagcctcggtcaccggatcggaagagacatcaccggacgaaccatcaccatcactgccggaagccgaggacgcgccgccttcgaactgattggagaatcgcaatacaatctggcgcaaggccgtggctttgcccgtatgctcggaggcggtggcaagcgtgctcatcgcggcatcgaccttggattgagcgtcggcgagttcatcgctaccgttggtttcggcgatggcttggctctcgtaagcggtggcgcccgaggacgtgccgccggtcagggcgctcaaattggccgtgtaaacgtccgtgtatttcatcgaatacggaatcattgcggcggagagctggctctggccatcggcgtattgcttggagccttgagtggcttcctccgaagcctcggcgatcagatcatccaccagtccggtggtgccttgctgctggatgcggcgaatcacctcgtccaacgcatcgaccgcaccggcatgctgatgtgcggcactgacgttgttcaccgcgttggccaagtcgagtacggcttgagccaaaggcgtgtccccggacagttcgccggccgtgcccatcaacgccggcaactgggtggaggtgccaatcgatccagacaggtgcgtggtatatgagcccacatacgcggccatatagtcttcaaacgtccgcttatgggcggtttcgcgttcggccactacagacttgttcagcgcacgttcgttatcgcgcagggtttgaagctgctcgatgagctgttgctgttcaccagaaccggcgtcggtcagtgaatcgaccagtgtggcggcagaggcggtgagttgggcgacatccgtatcggcagcaggctgtgcggcagcattcgcagcattcgcggcatcgggattagcaccaactgccggactgctggaattggaaggcaatacggcgagcgccacggaactcatggagaagtctttggcgttcatatagcagctgaattccaagccggttgcggcttttccagctgcggcgactacggtattggaaccttgcgtggtcaccgtaatggagttgtcagcggaaacatcatcggctacctgcgtaggcacggtaaaggcgacaaccgggatcgtacggttggcttccttggtttgcggcttaatatcgatatacacgccgatcagtccagacgcgccggcaacctcgtttgcctcgacgttcggaccgtcaagcgagtaggtgacgctgactttccatggcagggtggcggcggaagcggggatacgagaaaccttggacgtgccggaattactattggcggaatcggtatcagtggaaccgctattgccggaatcggcactggcgccattgccggcgccgcccttccctaccacataccaacggaccggctccccttcggcatcggtgacggcgtacatatcacttgccgtagcgagcaccggaccgtaatcaaccggagtcggacgagacatccaagcaccgccgagaatcgaagccacgcacaatgcgcaactgaccagtgcggcaccacatctcatctacgtatcccattcatacagtcgaccactacgggcattccattcccgtattaatgtagtcgctgcaggcaacttgccctatagacgaatatccgaaaggtgcccattcgctgcgggcgaatcaggcgaatacgtcgagtacgcccgggtcaccaccggcatcggctatgcgctggtggcgcttcttggcttcggtaaccacgaattcacggtacatttcggcaatttccggatcaagcccggcatcgatggcgatgcggtggaggcgttcgatctgatagtcctcacgcttggtgtcttcgggcgcgaatccggcgttggctttgagcacgccgacctgcgaggtggccttgaaccgctcggccagtaatgcgatgaccgccgaatcgatgttatcgatggtttggcgcagcgctttgatgcgcgccaccgcttgtgcggtttccgggtgggccgccgcctgggcggagtcgatggtggtcctttgccagtcgctgctcgtttcgctcatagattcgaggatactcccgattacggctttgcacgatgcgcaaagtcagatatctcagatgtcatagtcgccggtgaggatatggctggcatccgcatcgccgaacatggccgcaccactgcccactcccaaaacaatcgaacccagtgatgcctctttcatctcatatatcgtcagcgtgcatgtgaacgttgacggcaatactacaactgcaatgtgatagttgatgtatttgcatcagatacgacaagggctgcaccccgtatcaatcagggtgcagcccttacactattgttcagcggtctgatcagttgccgttgaccgcgttgccggtgttggcctgctgcacgatggcggcgaggaagtcgcggttggtggcggtcttcttgaggcgcggcaccagcgtctggtaggcctgctcgggctccatgccgcccagcagtcgacgcagacggtagataatcggcagttcctgcgggttggtgatgagctcctcgcggcgggtgccggaagcgttgatgtcgatggccgggaacagtcgcttgtccgccagctcgcgggacaggcgcagttccatgttgccggtgcccttgaactcctcgaaaatcacctcgtccatcttggagccggtttccaccagcgcagatgagatgatggtcagggagccgccgttttcgatgttgcgggccgcaccgaagaacttcttcggcgggtagagggcctgcgcgtccacaccaccggacaggatgcggccggaggcaggggctgcgatgttgtaagcgcgagccagtcgggtcatggaatcgagcagtacgaccacgtcctggccgagctccacaagacgcttggcgcgttcgacggccagttcggcaaccgtagtgtgatcggaggccggacggtcgaaggtggaggaaatgacctcgccctggaccgtgcgctccatatcggtgacctcttcgggtcgctcgtccacgagcaccaccataaggtggacctcggggttgttggcggcgatggagttggcgatgttctgcagggtgatggtcttaccggccttcggcggggagacaatcaggccacgctggcccttgccgattggggaaacgatgtccatgatacggccggtgagcttgttcggggcggtctcctgcttcaaacgctcctgcgggtacagcggcgtgagcttggagaactgcggacggttgagcgcttcttcaacgctttggccgttgatggaatcgatggcctgcagcggcacgaacttctggcgctggttgcggcggtcgccttcacgcggggcgcgaatcgaaccatgcacggcatcgcccttgcgcaggccgtacttcttgacctggcccatggaaacgtacacgtcgttcgggccgggcaggtagccggaagtgcgcacaaaagcgtaggagtcgagcacgtcgacgatgccggccaccggcaccagatcctcctgcggctcttcgcggcggctatcacggtcattgcgatcgctacgattatcgcgatcatcatagcgacgatcatcatcggcgttgtcgcgatcacggccacgcatgcgacggttacggcgatcgctgcgatcattacgggtatcgcgatcgttgcgatcgctacggtcgcggcggttacgacgcacgaactcgtgatcgtcgttctgctcgccgtcttcggacgtttcctcgtgcttctgcgtgggcagcgtggccaggatatcgtcgaggtcacgcacggtttcttcgctgttttccgcagtgcgacgacggcggcgaggctgctcgtcctcatcatcacggactcggcgaatcagcggaacttccacgtcctcgtgacgctcgcggcgacgctcggtaggcgctgcatctcccaaatcgagcgtggccagcagatcgccggcctcatcggccttcttgcgcggcttgcggcgagcgaaatcgggctggtcgtcatcgcgacgacggcgggccgcacgcggttcggatgcggcatcatcggcggccttacgacgggtgcgtcgcggttcggtctcgtccttcttggcatcgtcggccacgggaagcggcaaatcgagctgcggttccgtggcagccggagccggagccggcgactgggtggccacgtcagcattgtctgtggtgttggcctcagcggcatcggactgcggagccttgacgaccttggcggttttggcggccttgggggcgcgcacggtcacaccggccggcggctctccaccattgcgcgccgcctgcagggtggcgagcagctcgggcttgcgcatggtcgacgtgccgcgcaggcccatctgtttagcgagctctttgagctcaggcagcttcatatcctcaagattctggctatttgccactggttgccctttccataccgaacagacccatgcctatccaggcgttaagagtgattattgcggttgcaccgctcatgaatgttcgctgcgtctctgagtctctgcgaacttcgttcactgtacaacgccaactcgaccaacgcaaaacggcccgccgaaaaccaaaaaagctccctctgtgacgagggagctcaacaaggtttattcacttttcttcgtggtaggacttttcggtgttgacggaccacacgttcttcttggacgtcttgccggtcttgatgttgccgacggcctccatggcggtggccatggagtggtccatgttgttgtagcggtgctggccgttacggcccacgcagtacaggttgccgaagccgtcgaggtactcgatgagctcgtccatgtgctcataggtgtcgaagtaggcggggtacgccttcctgacgcgctcacgatgggagtcgatgacctcgtccggaccgttgatcacacgcatgcgggtgagctcggaaatcgcgaacttggtgacatcctcctcgctcatgttccagaacgagtcgccctcctcgcagaagtactcgagaccgatccacacggtgtcgtccacgtccttgaccaggtacgggctccagttgttgaagatctgcagacgtccgaccttgtagcccgggtcctgcacgtagatccagcagtccggcacgatcggcggattgccgagggtggggatgctggtggtgttcttgagcttcaggtgcttgaccagcaggcccacggtcacgaaatcgcggtacggcaggccgttggccacctcggtcatatcggccggggcgggcttggaatcaacggcctcgggatcggcgccggccgcgtcgatggcgttgaccaggtccttgaccggcatcgaggagatgaactggtcgccggaaagctcggtgcggttgccctcggaatcctcgtacaccacggaagacacggcaccatcggtctggcggacctcgaccaccctggcgtcggtcagcaccttgacgccggcggcctcgcaattggactcgacggtctcccacagctggccgggaccgtacttcggataccagaactcctcgatcagcgaggtctcgacctccgcgttggagcgcttcttgggcagcagcttctggaaggcgttcttgagcacgcccatgatggacaggcccttgacgcgctgggcgccccagtcggcggagatctgggaggggtggcggccccacagcttctccgtgtagccctcgaagaacatcgaatacagcttgcggccgaaacggttgatgtagaagttctccagattgtcttccggcagcttgtggaacatggacttcaggtagctgaagccggccaccatggtgagcttgaagcccatggccttcaacgtgttggggctcagcgaaatcgggtaatcgaagaagtggcggttccagaagatacgggacactcggtggcgcttgagcatcaccttgtcctccgtctccggatcggggccgcccggctccatgtcgtggtcgcggccgagcttcttgtcatcataggagggtgcgccctgcaacggcagaacggtcttccaccaatccatgatgcgttcgtctttggagaagaaacggtggccgccgatatccatgcggttgccgttgtgcttcacggtgcgcgagataccgccgaattcgcgggtcccctccagcacggtcacgtcgtacttgtcggcaccgccgtccttgatgagttcccatgcggcggtaagtccagccggaccgccgccgataatcactacggattgcttgtcggtcattatgctccttataaacgcaaaatcagagacagtctactagaagccccggaatcgcacaccgaaagatgagcgaatgcttacagaattctcccgatatacgaccgatgcgccgtctttccatcagcagaaaggcgacgcatcgaatcgtgaggtaggggtattcggcaacgttgcgtcacacacagcgcggcgaatcggtttggtcttaggctaattcgtcagcgacgaactttccatagattcagcgagatgcctgcaagtgcaagcagcatcataatccccgcaacaccagtaacggcaacaccagtacgactcaactcgttttccgtaccattagcctgagtgttgctgggctgatgagttcccgcaccattgttattcggagtggtactcgttccttcaccagtgttaggtcctgtgcccggctgcgttgtggaatcatcagtcagatgcgcatcgtcgcctagggtttggtggtcggaggccaagcaacttttaagctcagtgagcttgtaccacgtggaaccatcggcaatcggcgtgcattcggagcggaaggcgatttcctgctcgttgtagagcatacgaacgagcggcgtgtaggcacggccggtcttcgggtcgttgccggatttgacggcaacatcccactgcacattagcggccatcggagtcaccgattcaccgcgccattcattgttggcgtaggtgtacacgtcggtggtgctggcggccgcctgctgggtggaaccgggaaggccaagcagcgcggcgaacggcatcatcgtttcggcatgggcaaagcggaaagtagcaacggtggatccgccgtttacgcgctcatcaatcgacgagaagaaatcgtcaagcagcggctgtgcgattgtgtaggtctcgtcttggccggcgtagctcgggcccttctcgtagaagtcctcggcgtcaagcgcccaggcgaacaacttggcgtcgtctgcctgctcaccttggaagtactggttgaagtcgaaggtatggctgccggtgttctcgttctccatatcagcggcgatgatgtacaggttgtacagatccatcgcggcatcgtattcggaggcgatcttcttcttggctgcgccgcaggcgtcggcatccttgctggggtcggctcccggcgcgcagttggcctcgccgcccttggtgccatcgacagtgttgtaccaggcgtacgtgccgtcggccagtttggcgaggaagtcatcggtgaagatttgtgaaagcaaatcgtgagaggctgttttcacgtcctcgttttcggcgatggtttgctcagcgcctgcgataatcgcatcgttttccacgaagttctggtaatcgtcggcacgctgcttggcctcaccggttttctcagtgccgtccgggttttcggacttgtggaagtacagcgtgttcggcgtcttgtcgaaagccgccgcctcgccggtgccggccggatcggcgggcgtcacagtgctgttcgccagtttattgttcgaggccgcgttgaaaccgcgagcaaaattctcgcctgattcagtagcgcgggcttcgccagaggactgataggcaatcttgccaccgtccttggctgcgttgtcgaacagcgtcttgttgcgctcgtaggcacgtgcgccaatgccctgatgttggtcagcaccctgaccggtgagcataccgtagccattctccacatttgcggcggtgatggctttgagattcttcatgaattcggacttgatggcatcagacttaaaaccgttatccgcttcggcggcttcggccatcttcataagcaatgcgtcgtatttgtagctggacaggccgcgtgaaccgtggcgagccatcgactcggtgtataccgtttcgtagccttccggcgcctggctatagctggcagtggtcgcttcgctaggtgccacatatggctgcttgctgctgtaatactggccatcggcctccaaagccatggcgtgcggaacggtcaggatgccaccggccagcaatgtggcggcagcaaccacgcccgcgatggagcccttaaggccctgctgcatatggtgtgtgttcatgcagcattttctatcagccgcaagcaaacaagacacacgatggcaaggttacgagtctgaacttttgctatgcgttgtatgaacaatgcgcgacgccccgccgtaagatgacggaatgccgcgcattgtcaatacaggctgtatcagacgattgcctgtcagtgaatatcgtcgggaatgtcgatatcggttttctggacttcttcgacgttcacgtccttgaaggtcacgatgcgcacggacttgacgaaacggctggaacggtagacatcccatacccatgcgtcagtcagctgcacatcgaaatacacgtcctgaccagcggaacgcacgttgaaatcgaccttattcgccaagtagaagcgacgctcagtctccaccacataggtgaacagcttgatgacgtcacggtattccctatacagcgcgagttcggcgtcggtttcgtaattgtcgagatcctcggcactcatgcttgtttactcactcactttccgtatcgcgtttgcggccgcggcccagcgtacgccaccatgcttcctttgagggcttgcgttctgcctgaccgtacggccagttgctttcctcttcgagactgtggcgcgtgttcttctgcgtatcgtcgtggtgctcggcctgtggctcgactggctgtgcggccgccggcgtctgggcctgggactgcacgtcactcgtcgtggcgccggctgcctcaccacgctgtgccggctcgggttccggcttgttctgctggatggcgatggaatgctcgcgcgcggacagcgcttccttgacacccgggttgtcctcaatcaagtgcatgccaaaagcgtcaagcgaacgaatcggatcgtactcgtcagccaacgtgtccatgacgataaggtcctggtatttgttgttttcggcatcccacaacgcgtcgcgcgaggtgccggacggcacgaagccgagcgactggtagaccgaaatcgagcggctgttcttttccggcacgctcacccagatgcggtgcatgcccaagccggccggttcgggcgcgaaaccgtaggtcatcacacgcggcatggcgtcacgggagtagccgcggccacggtattcacggcccaagatgatctggatgcgggcggacttggaccagccgtcgatgtcgataaggaaaatcatgccgatgacattatcggtgctggccgcatcgagctgaccgtcatcgtcatggtcggcgtcagtcaatacggcccatgcgatggtgcggcgggattccggatcacccacaccggattcggcgggtgcctgaccggcttcccaagcctgggagcggcggacccacgtgtgtacgatggcgcgttcggtgaccgcatccttacctgtgatcttggatgcgccatagaaggcatcaagttcatccaaacgaggcaggtcctcgacggtggcggggcgcaggtgcaccatttcgccacggattggcggaatgacgatgctctgtggcagatcgcgcttcagttgcgcttcggtagccatgctcagcgtctcgttggttgcggtcatcggtatacgtcccccggttcggcttgtttcggctcacggtccagtgccgaacatatcttactcgactgggtgaacgctggaaatgctctgagtcgactttcttacagaatcaataaaggctcccgctggcgggagctgtctaacggatttgaactggagaatttccctacaaataagtgctcccgctggcgggagctgtccgcgaagcggactgagggtggtcatccgtacatggcgaccaccctcagtctcactccgttcgacagctcccaccagcgggagccagtgaatctaatcagcccttgatcttgcccatgacgaccttggtgacggccttggcgtcggcctgaccgcgcgtggccttcatcacggcaccgatgattacacccatcggcttcatgttgccgctcttgagcttctcgacaacgtccgggttggcttcgaacgccgcgtcgacggccgcctcgatggcaccgttgtcttcgacgatcttgtagtcgtgcttcttgacgacttcatccggagtgccttcgcccttaagcacgccttcgacggtctgcttggcgagcttgtcgttgagcttgccggaggcgatgagcttctcgacctcggccacatcggccggggtgatcggcagctcttcgagggacacacccttggcgttggcttcgcgggaaagctcgcccagccaccacttgcgggcaccggcagccttggcaccggccttgacggtttcctcaatcaggtcgagggcgtcggcgttgaggatgtcgcgcatctgcagatcactcaggccccactcggacttgaggcggttgcggcgctcgcgcggcatttccggcatctgggccttcatctcctcgatgtgctccttggtgatgtggagcatgacgaggtcggggtccgggaagtagcggtagtcgtcggcatcggacttcagacggccgccagcggtggtctgcgtagcctcatcccagtggcgggtctcctgcagaatctccttgccgtcgtccagacgagcggcctgacggcgaatctcgtactggatggtcttctcgatgccgcggaacgagttcacattcttggtctcggaacgggtgccgtacggagcgtccgggctcgggcgcaacgagacgttcacgtcagcgcgcatgttgccctgctccatacgagcgtgggagatgttcaacgcgcgcacgatgtcgcggatggcgcgcacataggcaccggcgatttcgggagcgcggtcgcccgccccctcgatcggcttggtgacgatctcaatcagcggcacaccggcacggttgtagtcgaccagcgagtggtcggcaccttcgatacggccgtcggcgccacccacgtgggtgttcttgccggcgtcgtcctcgatgtgcgcgcgctcgatcggcacgcggaacacggtgccgtcttccagctcgacgtccaggtagccgttgccgttggtgggcttgtcgtactgcgagatctggtagtcgcgcggcatgtccgggtagaagtagttcttacgggcgaactggctccactcggcgatttcgcagtgcagggccagacccagcttgatggcgtaatcgacggcggtcttgttgatcaccggcagagagcccggcaggccaaggctcaccggggtcagctcggtgttcggctcgccaccgaactcgatgtgggccgggcagaacagcttggtgttcgtggacagctccacgtgggtttccagaccgaagaccacatcgtacttcttggtggcatcggcgtacttcatcagtttttcagccatgatgttgtttctttccttccgatgctcacttgcccagaccgtcaagccacggggtcttgaggtcgttccagatcgggccgttccagctgtcttccagcgcggcttcgagggccgcggccggcttgtacatgacttcgtcgcgctgctgcggggcgatgaactggaagccgacgggcaggccgtcgtcggacaggccggccgggatggacatggcaggcacgccggcgaggttggccggaatggtggcgatgtcgttcatgtacatggccagcgggtcgtccatcttctcgccgaacttgaaggcggtggacgggctggtgggggccacgagcacgtcgacctgttcgaaggccttcttgaagtcttcgataatcagcgtgcggaccttctgggccgagccgtaccaggcgtcgtagtagccggcggacagggcgtaggtgccgaggatgatacggcgcttgacctcgtcgccgaagccggcttcacgggtgtaggccatcatgttggcggcggtctgcggcacgccggtcggcggcatcacgcgcaggccgtagcgcatgccatcgtaacgggccaggttggagctgacctcggacggcatgatgatgtagtaagcgcctagcgagtagccgatgtgcgggaccgagacctcaacgacctcggcacccatctccttgagcttgtcgacggcctcgttgaagcgggcctcgacgccgggctggaagccgtcgccgccgagttccttgatgaggccgaccttcatacccttcagatcgcgcttggcgccttcgcgggcggcggcgaccatcgggcgcgggccttcggggatggaggtggagtcacgcttgtcgtggccaccgatgatctcctgcagcagtgcggagtcgagcacggtgcgggagaccgggccgatctggtcgagcgaggaggccatggcgatggctccgaaacgggagacgccgccgtaggtgggtttgacgcccacggtgccggtcagggcgccgggctggcgaatcgagccaccagtgtcggtgccgagggcgatcggtgcctcgaatgcggcgactgcggaggcggagccaccaccggaaccgccgggcacgcgctcggtatcccacgggttgtgggtggtctggtaggcggagtgctcggtggaggagccctgggcgaattcgtcgaggttggtcttgccgagaatcggcatgccggcggccttgagcttttcgatgacggtggcgtcgtacggcggcacccagccttcgaggatcttggaggcggcggtggtttcgatgcccttggtgacgatcatgtccttgatggcgatcggcacaccagccagctcaggcagggcggccttgtcttcggcggacttggcgtcgaaggcgtcggcctgctcgagagccacatcgccggaaaccttcaggaaggccttgatggacggctcggcagcctcgatcaccttgaggtgggcttcgacgagctcgcgagaggtgacgtcgcccttcttgacggcagcggcctgctcggcagcagacagtttgacgagagttgcggtttcgttgctcatcgattactcctcgcttcccaggattcgcggtgccacgaacatgccggcctcggtcttcgggccaccggcgagcgcctcttcctgcgtgagcggggtttcggcgacgtccgggcgcaggtaggcttccagcggaaccgggttggcggtcggcggcacatcgtcggaggcgacttcctggaccttgttgatggagtctgcgatgacgttcagttcgccctgcagacgggtgatttcctcatcggtgagcgcgattcgggccagatcgcccaaatgcacgatttcttcgcgtgaaaatgttggcatggccataactatatgagccgtatgtgacacgcagttgtcgggaaaccgcattttcctaccctttgagaccatttcagcagggcaggcactcgggtcattatttgatatccgcttttctggtgacgatgagaccgccgatccatgcggcaggattgtcggcgcatggctacacgcctgatacggcgtgttgggcaatccatgcgtgcatggccacggccgccgcagcgcctgcattaatggagcgcacggaaccgaattgagagatgtagaccacatcgtcggccaatgcgagggccttctcgctcaatccggggccttctgcaccgaagagcagcaggcaccgcttggggaaggcataggcttccatcggcactgcgccgggaataatgtcgagggcgatgacgcgggcggcttgaagctccttgatgcgtgcatcacaagcatcgatttcggccagcagctcatgaaggtgcttgttgtctccatccacagccacatcatgcgcatggatggcggcggcaccggccttggctcgttcataggcgatttcaccggcgatgcgatgatgccagctttccaccagttcggcgatggaggggtggtgttcgacgtgctggtacagttcggtcatcaacgcgcccttgcgattccacttatgtggaccgacaatgtgtacgcgcttggcctggaaggcattagcggtgcggaccatggaaccgatgttaaaatcgtgggtccagttttccaccgcaacttcgaagtcgtgacgccctcgagcgtcaagatcggccttaatggcagcaacggtccagtagcggtaacggtccaatacgttgcggcggtctccgtcgttcaacagcaccgagtcgaaacgaccgtcataattcgaagaagtcggatcatcgggacgaggctcaccgggatgggtctcagaccacggcccaaggccgatttcacggaattccggttcacctgaagctttggcagccaaagaaatctggttgggtgcgtgcaatctttctcctcgataacgctattcaccggttcctcttagtcagcttcgctgctcagcccggctgactttatgtgagggaagtcaaaggtggatttaccgcagttcggattcgtcgaagacctggatgaaggggagcgtttgctcgtcgccggtggaggggttgaccacattgatgtctttggcaccgccaccgaccagcgaggcgatggccacgaccttggcacccagctgctccactatgccaaagtcgaggctcagctcattgccgttgcgcagggtgaccagcgagctggtctgcacgtacgacttttcggacagccaagcatccaacagcaccacacggcggccttcgatggaggggcccttgatggacgggtagacgaagtccatcacgaatccatctaggtcctcgccacgagaggcggcggcctggatcatggcagacaccatgggcacagatgctgcggtcaaggcaccaacagcatcgaagtcatcaatcgaatagcccgcatcttccaaagcgtcaatcagtacatggcccatgacagtggcggcacggtggtcgaaagtcaccgcggcaagttcggagaacgggcggcccaccacatgctccttcagcaaggtggctagctgttcacgcggctccagcatggcaaagtcattatggctcttcgcgacggcaaggtccggggtaccagtggggcggaatccagattcagtcatgactccagactatcgcctgaggcagtcagatgagtatcaccttcatcggccggcaccacttcaggggcggacagttcgctcacattgcctttatctgattcgatgatcggtacttcctcgatgatcttggtcggttcgattttttgcagcttgcgagcggtgggcaacacacggcgttccaaactggacgcgaacttgttgtaggcactgaccgtcttagtaatctgggtgcccaatttgatggcataatcacccagcgtggagaaccgttcgtacagttctcgggacagatcgaacagctgcttggcgtcatcggtgagcgactgctgctgccaggcataggccacggatttcagcacggcccacagcgtgaccggcgaggtgagcgccactttgcgagagaacgcatcatccatcagtgtgggatcggcttcgagtgcggcctgcagtagtgcctcattggggatgaaggccaccacaaaatcaggtgctacatcaaaggcattccaataggccttttcgccgagagcacgtacatgctcgcgcaacgccttggcatgggaccgcagcaaatcatcgcggcgggcaatatcctcggggctggcggtgtccgggatttcgcaggcacgctggtaatcggcataaggcactttggcatcaatcggaatggtcttgcctcccggcagatgcacgatcatatccgggcgcaacgtacgcccatcggcatccgtgaccaccacctgggtgtcgaaatcgacatgttccagcaatccggcggactcgacaatgttcttgagctgggcctcgccccacgcgccacgcaccttgttgttgcgcaacgcggcggacagggaactggtttccttgtccaaacgggcctgctgatcgttgagccccttgagttgggctcccaatgcgcccatttccctcttgcggccctcttcgatctgcgtgaccttgttctgcaaggtatcaagattcttggccactggcgcaagcgcctcgagcaccttgctctgttctttcaaacgtgcttcctgttcagcacgcttgacctcggcggcctgagcatccgcctgacgcttccgttctgcctccgcagctgcacgctcacgttcctgctgaatgcgaatctgctcagcctgctgcgcctgggcaagttgtgacttggcgaaagccaattgctggttcacgccttcaatctgagcttgcgcggcagcattgcgagcactgagctcagcgttctcgaatcgcgcattctccagcgaggtcttggcctcctccagctcctcgcttttgacgcctcgagccatctcctgacccttatgacggcctagcacgaagccggcgaagaggccaagccctgcaccaaccactagcacgacgatgacgataatcacggttcctatttgctcaaacatggtacccagtatgtcatcgatggtgaatgacggtaaaactcgtcacgatttgacgagacgcgcaatggccgcggaagcctccgcaagtttttcatcggccacctcgccgccctgaatcgacgcctgccgcacgcaatggttgagatgatcgtccagcagcaataacgccacggatttcagcgccgaattcgacgccgaaatctgcgtcaggatatcgatgcagtatttgtcatcctccaccatctgcgtgatggcacgcacctgtccttcgatacggcgcaatcgtgcgatgaccttggccttgtcttcgtcataaccatgcatcgcaaaccccctgatacttatccgtcagctgaacacaccccattatataccctctaggggtatagggtatacactgttgttcagtacaacaaacaaggggaaggaacggttatggagctcagcatcttctcggccgccacggcgctgatagcggcggccgcattgacatggctggtactgcggttcttcttcggaacgcagaaagccacggccggggccatggacgcctccggcgaacgccaatccgcaacaatcaccgtcaagggcgggtactcccccgccgtgatcagcatgcgcacgggtacgccgatcacgctgactttcgatcgacaggagaccggcgaatgcacttcgcatgtggtgttcgcggatctggggcttgacgccatgctgccgggcaacgccaccaccgacgtggaactaccggcgttgccggcgggcgaatatccgtttgcatgcggcatgaatatggtgcatgggttgttgagggttgagggagaggagagcaaggacggtgcggataaggacgggcttcgcccgcgtgctgacggctcggccgaagccgagggggtctctccctcagacttgcgggttggagctccggttgtggatgcggcggaggccgagcggcgagaggcggctgaacgcgccaatgagatcaaggcgctgacgaagctggtgattgtgggcgcggtactgacgttgccggtattcgccgtcaccatgctgcatatggccaatcccgcgctggcgccgcattggatggtgaacccgtggctgcaggccattctcatcacgccggtgatgttctactgcgggcgtccgatccacacggtcggcttccccgcgctggcgcaccgctcccccgacatgaactcgctggtctcgctgggcacttcggccgcctacctgtattcgctggtgacctgcatcgccccgtgggtgttcccggagggctcgcgcgagccgtatttcgaatcggtgggcgtggtcatcaccctggtgctggtcggccgcctgctggagaccaaggcccgcgaaggcaccggcaaggcggtgcagtcgcttatcagactgcgcccgcgcaccgcgcacaagctcaacgccacttccgcagacaatgtggacggcatcgaatggcgtaatccggcgcatttcacggacaccgacatcgacgccatcgtcaccggcgacctgctgatcgtcaagaacggcgagcgcgtgcccacggacggcgtgatcgtggccggcgaggcgcgtatcgacgaatcgatgatcaccggcgaatccaagccggtctccaaaaccgcaggcgacccggtgaccggggccaccgtgctgctcaagggcgactgcgtgatgcgcgccacccaagtcggcgcggacacggtactctcgcagatcgcggcgatggtggcccgcgcccaggcgaccaaggcgccggtgcagcaactggccgataagatcgcccggtatttcgtaccggcggtgatgatcatcgccatctggacgttcgccatctgggtgtcactgggcccggcgccgcaactggcgcacgcgctggtcactgcggtcagtgtgctgatcatcgcctgcccgtgcgcgctgggactggccacgccgctgtcggtgacggtctcgctgggcttgggcgccaccaacggcgtgctggtcaccagtgccaaggcgctggaacaggcgcgtcgcatcggcaccgtggtgttcgacaagaccggcaccatcacgcgcggcgtggtggacgcggccgccgactgggacaagccgagctacgagcaggacacagtcaaggaaggctcgcgtgaggccgtcgcggcgttgcgcgcacgcggcatccgcacggtgatgctgtcgggcgacaaggccgaggtagccgggcgcatcgcccgcgaagtcggcatcgatacggtgatctgcgaggtcaagccggacggcaaggcctactggatcgccaaactgcagcgcgaacgcgacgaggccgccgccaagtccgcgtacggcacctcccgcacggccgcacaatcccgcactctgattgcgatggtgggcgacggcatcaacgacgcccccgcgctggctcaggcggatctcggcatcgccatcggcaccggcacggacgtggcgatgcagtcggcggacgtgaccttgatgagcggcgacttgcgcggcgtcatcaagaccatcaacctgtccaatgccacgatgcgcaacatccgcgagaatctggggtgggcgttcggctacaacgtcatcggcattccggtggccgccggcgtactctacccgttcaccggctggctgttgagcccgatgatcgcgggtctggcgatggcgttgagctcagtgtgcctggtgctgaacgcgaaccggctgcatggagcgaacatcaacgtgggtgctgccgatggtcccgccggttcgggcagcagcacggcggatgtcgaatcagccggatcggccgaatccgccaacgccgccaacatcaccggctccgccacatccaacgcgcctcacgagccgaccgtcatcatcgacgatcgcaccacgctgaatcaaaccaatcacgtatctgaccaatccaataatccaaccaacaaggagaacactatggatacgggaatgcacatgcaccacaccgcccccgcggacggcgaaaccgccaccgacccggtgtgcggcatgaccgtggctgtgaacgccgatgcgatcacgcgcgagtatgagggcaagtcctattacttctgcggcgaacactgtgccacgaacttcatgaaggccccgcaggtgttcctggagcagtagtctctgcgtttacctgattcaacgacaatggcctccgcccaaaacgagcggaggccatttgcatatatgaatcaatcaacgaatcagctggcgaagaagaacacgaacagccaagcgccgataatggcgccgacaatcggggccacaaccgggatccaggcctcgccccagcgggaggagcccttgtgcgggatcggcaggatggcgtgcagcagacgcggcatgaggtcgcgggccgggttcaggccagggccggtcgggccacccatggaggtcacgaggccccacacaatgaagccgacgacgatggaggcggcggcgtaatcctgcttgccccaagccagggacaggcagcacagggcgccgaagacgagcaccagggtgccgaacatctcgttgaggaagtagttgaccttctggttgtccgcgtcagtggtgcagaaggtgcccagaatcgcctcggcgtcctcggtctccttgtagtgcgggtagtaagtgatgtagacgatgagctggccgagcagggcgccgagcagctgggcgacgatgtacggcagcacgtcgctccacgggaacaggccgttgacggcctgggcgatggtcatggccgggttgatgtgcgcgccggagacgctaccgaacatgagcaccgggaacatgacgccgaagccgtagcccatggcgatgttcagccagccggcgtggtggcccttggtgttcttgagctcaacgttggccacggagccgttgccgaagatcatcagaatggcggtgccgaagaactcggcggccagcttggtaaagagaggataatccactgcttcttcttttctcttcgccgcgcaacaggcatggctgactgttcacggcattctgtgtgactggaaatccgttcgcggagccggcgacgcgatttacgctgggcgcgaaagcaaacgtggtgattgtacactttgccccacgacgaaatgccggcaagatgcgatgtcgaatgtccagccgaatgcaatgcccaaaaagccatcggaatcagccgaagcgaccttgaatctcagtggttgcgaatgacgttgcgcaggggcaggacgctggtgggcgagacggacagttcgtcgattcctaggcgcaggaacgtatcggtcaggctcaagtctgcgccaagctcgccgcagatgccgcaccagatgccatgacgatgggcagcctcgatagtcatctggatcatgcgcagcacagctggtgaatgcgggtcggcaaagcgttcgagactcgggttctgacggtcacaggccagcgtgtactgggtcaggtcgttggtgccgatggagaagaaatcgacttcggcggccagctcgtcggccataatgaccgacgcaggcgtctcaatcataacgccgatctggatactctcgttgaagtcgatgcgctcgccgcgcagctcgcttttggcttcttcaagaatccgcttggcgtcgcgtacctcctgcacagaggtgatcatgggcagcataatggcgatgttgccgtatgctgaggcgcgcaataatgcgcgtaactggactttgaaaatctccgggcgggtcaggcagatgcggattgcccggtaaccaagcgcgggattatcctcgtggctcagattgaagtagtcgacctgtttgtccgcgccgatgtcgagcgtacggatgatgaccggacggtcgcccatctcctgtgcgacttgtccgtatgcatcgaactgaaattcctcggtcggccagtcctcgcgttccagatacaggaactcactgcggaacaagccgatgccctcagcatcgttggccagcacggcggctgcgtcagagggacggctgatgttggcgtacaggtggacccgctgaccggacttggtttcggtgggcttgcccttgagcttccgcaggaggcttaggtgctcctcagcctcggccttcctgcgccggtattcggtcagcgtggcctcgtccgggtcgacgaataccgcaccgctggtgccgtcgattacggcaacgtgaccatcatcggccgggtcaaaggcgtcgccgatacctgtgatggcgggcaggcccatcgtgcgcgccagaatcgcggtgtgcgagttcgctgagcccttggcggtcacgaggcccaaaaccttagcgcggtcgagctgcgcggtatcgctgggagcaagatcttcggcgaagatgatgtggctttctccgttctgcgcgatcccgttctgcacaataccgttctgcacagcatcgccttgtacactgccatcctgcgccgtgctatcgcgtttgccttgcagcacgttcatcacgcggcgagaaacatccttgacatcagcggctcgagcctgcatggtcgagctatccatcgcagcgaacatggcggcgaactgttcggcggcgctcttcaccgcgaattcggcgttcaccttgtcttgcgcaatcaaaccttcgacgcattccgcatagtccgggtcctggagcataagccgatgggcgtcgaacagttcggccttgttttcgccgaactcagcggcgacgttgtcacgcagttgcttgagctgagcgacggccgtgtcacgggccgcgcggaatcgatccatctcggcctgcgggtcgtcgattaagcggcgttctacggcataatctacggcggcgagcacgcggaccgtgccgatagcaatgccagcggatacgctgacgccctgtatcgttctcattacaggtgctccttgaggaatcgctcgaactctgcagcagcgacagcttcatcgttgccctgcacccgaaccgtaacctcgtcaccttgttgaacatcaagtcccataacaccgaagatacgcttggcatccacggattttccaccgtaggcaacggtgatgctcgattcatattcctgcgctttggcaaccaaccggccagccgggcgggcgtgcatgccttcggggtcggatacggtgaacgtgaatatctgaggcatgacgttgctccttacacgtccggccgtcacgcgcgaagacggcctttccgcaccagctacggactgatactggaaaaaacaaaaaaccggaatctttcgattccggttgtctgtgcccccgcagggattcgaaccctggacacgctgattaagagtcagctgctctaaccaactgagctacaggggcttggttagatgttgaagtattccttgcaacaggtgataaatatactcagatttgaagcgaatgcaactctcggcgtgtcgcgcctatttccggcgtttttgctaatacaaaaatcccccatgcggcgcaaaccgcacgggggatgatgcttaagctcagactcttggtctgtgtgattccagcactaggccggaatgactcactcggccacgaccttcacgaagaaggaagcggtgatctccgggtggagggccaccttggcggggaaatcgccggtggtcttgatggtctcgacctcgatggccttcgggttcaccgcagccttgtcggacagagcgacggcgatggcctcgttggagataccaccgaacagcttgccggactcggacaccttggcggcgatctcgacggtagtgccctcgatggcggccttagcggcgacggcgtcctcgcgggtagcgacggccttggccagacgagcgcgcttcatagcgacgatctgagcctcagcgcccttggtccacgcgaaagcgaggccctgcgggaacaggtagttgcgggcgtagccggacttcacgtcgacaacgtcaccggaatggcccaggttggacacggtcttggtgagaataaccttggtttcagccattgttcaaagcctccctaactcagcgacccgaggtggcgtacggcagcagggccatctcgcgggcgttcttgatcgccttggacagctcacgctgctcctgcacggtcacgccggtgatacgacgggaacggatcttgccgcgatcggaaatgaacttacgcagcagcgcaacgtccttgtaatcgatctcggtgaccttggcggccttcagcgggttcggcttcttcttgaacggcttgaccggcggttgcggcctcttacgtgacatgatgttctccttataaatcttgatattgattgctgctggcagcggggaggcaagtactgatcagaactccgggtcggaatcgtcgccgccgaaatcggaggaagcgccgaacgtggagaagctaccggcatcagatgcaccggcattactccacgggtcgaccgcaggagcggacgggttggcgggagcggcagactgctgggagtatccagcgccaccaccctgatagccaccgttgtaaccgccctggccaccggcataaccaccttggccaccctggttgccatagccctgattggactgctgaccaccctggaaaccaccggaacgaccctggaagccgccctgaccggacgactggcgagtcacctgtgcggtggcgtagcgcagggagggcccgatctcatcgagctgcatctccacgacggttcgctgggaaccatcctgtgcctgataggaacgctgctggaggcgaccggtggcaatcacgcgcatgcccttcttcagggactgggcgcagtggtcggccagatcacgccaagcggagcacctcatgaacagcgcctgaccatcctcgaactggttggtctgacgattccaggttcgcggggtggaagcaatcgtgaagctcgccacggtcgcaccgctgccaatagtgcgcagctcggggtccgcagtgaggttgcccacgatggtgatgacggtttcacctgccataacggtccttcttacttaccttgaataccagctgttcagctgactaaacgcttgattcagcccttacgaagaatcttcgtacggatcacggattcgttgaggttcagaacacggtcaagctcatcgctggtagcgggctcggcggtgtacttcaccacgacgtagttgccttcggtcttaccggcaatctcataggcgagcttgcgacggccccagtaatcgggctcatcgaaagagccgccttccttggtgacgagttccagatactgctcggtcagcttcttcagaccgcgctcatccagctcaggatcggcgatgaacatcagttcgtacttgtgcgcagacatcacccacctccttcggactattcggccacggacgttccgtggcaggagtgtgtatgcgtgttagcccatgacgcagcaccaaaccggcaccgcctcttcgggcaacttggacagtctatatatgaggcgggacagggtatgcccatattcttgccggtttcgcgatgcccaccgttttggccaagcccacgcagcccgcggctcccatcactcccggagcggcaccggtagccgcacctggcgcgacctccaccaccatgaatgagcaacagaagaaaatcttcatcatcgttggtgccgtggccggcttcctcgtgctgttcggtatcgtgtatggcgtgctgtcttccgccgtgttcagcgcgaagagcgttgcgaacagctatgtggccgccatctcctccggcaactacgacaaggccaacaccatcgccgatcctcacgtgaatacgaaccagcgcgcactgctgaccagcaaggcatcctcgggcgagaacacgcgcatcaccaacgcgcgcatctcgcagacctccaataatgccgatggcaccgtgagcgcccagctgacgtacacgcttgaaggcaaggaggtcaacggcaacttcaccatcaaagacaataaggtcagtgtcgagttctccgagtgatttcggcaatctcaacactcttacgaaataagcaccccgccgtggcgttcgctgcggcggggtgcttgtacactggttaaggcgtaaatcacacagcgactcaaacaaaggatgcgaacgcatgtcggcgattcttgaaggcactccggataaacgactcgtattggtcacgggccgcgcctaccccgagctagctgagaaggtggccgaatgcttgggaaccgaaatcctcgaaaccacgtcctatgactttgccaatggcgagatgtacgtgcgtttcaccgaaccggtgcgcggtgcggacgtgttcgtgctgcagtgtcattcgggcgatatcaacaagtggatcatggaacagctcatcatgatcgatgctttgaagcgcgcctccgccaagtcgattaccgtggtggcgcccttcctcggctactcgcgccaggataagaagcaccgcggtcgtgagcccatcaccgcccgtctgattttcgatctgttccacgccgccggtgcagaccgcattatgacggtcgatctgcacgccgctcaggagcagggtttcttcgatggtccggtcgatcatctaaccgccatgccggtgctgctcgattacgtgcgttccacccttgatctgggcaacaccaccatcgtgtccccggatgccggccgtatcaaagtgtccgaacagtgggccgccaagctaggcaatctgccgctggcattcatccacaaacagcgtgatattactcgtccgaaccatgccgaggcacatggcattatcggcgatgtcgacggccgcgactgcgtggtcatcgacgacatggtcgataccgccggtactatctgcgaagccgtgcgcaccctgaacgaatccggcgccaagtcggtgacgctggtcgccacccatggcctgctctccggcccggccgtggagcgcctgtctcactgcggcgcgcatgaaatcgtgtttatggacaccgtgccgattcccgaagagaagcgcctgccgaatatgaccgtactgtcttgcgcaccgctgctggccgcgggtattcgctccgtgttcgaggaaggttccgtggcgattctgctcgacggcctgcccgaggacatgcgtccgcgcaatatctatgcgtgattgatacgccgaaaatccttacgaaaaaacgccgcttggctattgatcaagcggtgttttttcgtatagctccaatcagatgaaggcgcgctcgccgaagatggcggtgccgacgcgcacgatggtggagccttcttcgatggcgtaggccatgtcatgggtcatgcccattgacagttcggtgcagtcggccgtgccttcggcaccggaggcaagaatctggtcacgagtgcggcgcagatgcgcgaagcccgcacgaatcgtgcgctcatcatccacatgggcaccaatagtcatcaatccctgcaagcgcagtccgcccatcgcaccgatgcgctgggccaagtcgatggcgtggctgggtgcgcagccggacttcgattcctcgccggattcgttcacctccagcaacacgccgaccgtgatgccgcgcatggtggcacggcgggcgatcttttccgccagttcgatggaatccacggattcgatggtgtccactaccggcagcaccttgccgattttattggcttgcaattggccgatgagatggaaaggaatatgcgttgcagctgcggcattggccgtgtcagcctcagcggcatcaatcacgcctagcgaataaccacgctcccccagtcgttttgccagaccgtcagccttgacagtaatctcctgtggacgattctcaccaatcacgcgaataccagcatcgatagccgccagaatctcgccgacatcgcgcgtcttggtggcagccagcaattggaccgaaccggcagcacgcccggctgcggactccgctgaggcaatccggtcaagcacgcgatgcacaccatcagtaatctcttgtgcgcgcgcctgatcgataacttcgttggcgagatccttatggtccatgtatgccgtcattgctgcccctgttcgtagattccccaccatcgtagtctcatacgcgcacataatgcttgttattgaacaaaagtgaagcccccgctgttcatgcgcgggggcttggtgatgctaggccgagcgagtgggactagcaggtaccggacttgcggcgcttgaggatgattacacccgcaacagcaagtaccacggcgaggatgccaacaccaagcacggctgcaccggtgtcaggtatcttcttgtgcttgccggagtctgcatcacccttgttctggttggaatcgttgccttggttgggcttgtccgtgccggaaccgggcttatcgccaccctggccaggcttcgtggtgctcttctcaaccagacccgcgatggcatcgctgattgcctcagtcgcagcctgtacgtcagactgggcggcctgaccatcactcgtcagcgcattcgccgtagcgactgccgaatcaagcacggccagcgattcatcagtccactttgtgcgatccacggcagcagcggcatcgagctgagcgctcagcgcggcacgatcttgcaccgtagctacaagcaccagcttcttcgctgcctgcttcagctgggttgcggcatccaccaccgcagcttcggtggcatcctcagccttatacacctgctgcgccgaatccaataccgccgcgtactccgcccatgaagtctcggtgtacttggaggcatcgtcagccttaggcgagtcagcgagcgcctgcttgagctcggtcttgtcgatcggtgtgggctcaggcggctcaggcgtactgtcgtcaatggcatgaacctgccattcggcaacagccggagaagccgagccggacgtgataaccatacgcaacttggtagtcttgaccggagtgttccacgtgccatcagaccaccccttggcatcgccggtggcccagccagcagacggtgaattggcggtcacagtgtaggtggcgtcggaaatatccacgaagttgccggcaccgttgttcgccaaggcgtcccagtactgcaattcccacgatgccggaatacccaatccgccatcatccgaggtgaattgcacgcggctagagtcgatagtcacttcacggtcccactcgtagtcgaggcgcatctcaccggtgttgggccaagtgccccagacatcctcgttggcaatggtgatatcgggaatgatcttgccgtcgttcaacgcggcggcacccttgacccagccggatgccttgccgtccacatcggtggcggtggcatcgccctcaatgtagccggtcagcggcacggaagtgtcggatggaatgtcggttttcgccgaagcggacacgttgccggccttatcggtggcgcggtagtacacggtggcgcgcgacgcgctcggtgcagcaatcggcttgctgtacgtggcccattgaccgtctgtgccaatgcggtattcaattgatgcgacaccggaaccggtgccgtcatcagcggtcaaggtcagcgtgcgctcctccttatcggcggcggtcacggttggcgcggcggagtccaccttgccgccggccttggccacgtcggaaacgttgccggcctgatcggtggcgcgagcccacacttcgacatcgccctgctgggaaagcgtggcaatggccgcgtttgcattcgcggcgatggtggtccagctcttgccttgatcagcggaaatctccagcttggcgataggtgcggtgtcgtccgtggcctgcacggtggcgaacggagcggtggtgagccactcgctattgcctgcgttagcagtaacggcaacggttacagtcggcttcgtggtatcagcggcaggctggtagccgtcctgcacggtgacatttaccgacacattgccctgctcgcttgcctcaccgggcacgccggcgaccacgccgtaggccgtaaacgaaccgaccttggcatacgaggaagcatcaactggacgccaaattactggggaggcaacggttgggttcccgtacttcacatccactgtggccggcagagtaggcgcagtaccggtggcggtggtcacgctcttcggcgcagtgattgccggcgattcgctggagtcggagccgacttcccattcagcaacggccacggaggcatagccgccatccacagcttgaccggtcatgtcgagctttaaggcagtagtggtcaccgcatcgaaggtgacggcgttggggttggccttgcctgtggtcgttgtataggcactcgggttggtgacatccttccatgtgccgtccgcgtccaagtactgaatcttccacgaggcgggcgcgcgcagagcgttggaatccacgtcgaaccaaaccttagacgagttgacgcgcacagtgccatcccattggtagaccagagaatcgccggactgcgattgcgggatagaacggtagttggtccagtgattcggcgggaccacagcggtttgcaacacacggccgtcgttcaccgaacccttccaagcaggcgtttcagtgaacgtggcgctcacctttgcgtacggagccacgttggtggagggctgcgttttctcggccttggttggatgggcggtggaaaccatctggccgtcggcggtccaatcgacttcatcaatgcacacggcacggcggaaatcggtgccgccttccttgtcgccggtgtgataggtcacataccatttgtcgccgaactggagcaccgaggggtgcatcgtggtggccgagccagaaggcacgattacgccttggtacttccatgggccgagcgggctgtcggaagtggagtactggatgcaagcttgatagttcgattccacgcaggtggccgtgcccgaaccgggcttaccgccgtcgtacacgttgtaataggtatcgcccttacggaacacccacgccgcctcgaagaatcccttcgggccgttcgcgttgctgtccgcgtccttcatggtgtggaggttcggcgtggtgccatcagccttggtttccacctcggtgtatgaggtgcggccggttgtggcgtccttcttcatcttgatggcgagctgagtgccgaacgtaccaaagtgcaaatatccggtgccatcctcgtccacaaagaatgccggatcgatggtttcaatctgggtttgcgatgtggtgagcagcggcttgccgatggcatccttccacgggccgagcggactcttcgacttggccacgccgatggcgaacgggtcctgtccagccgcctcagaagccttgtccttcaccggcacgtagtagtagaaccaatcatcggaagtgtcgctcggggtgccgttatcgtcggctacgacttggccggcgtacgcgccatcgccggtggcccagctgaacaggtctgccttggcgatggtcttgtaatgtgtccatttgccttgattcaggccgtcttcatcggtgacgtatacgccccagtccttcatgttgaaggagccgtagtcgggcgaagcctcatcgtgaccggtgaagacgaagagtttgccgtcatagctcagcgcggatgcatctgcagagtagtagttctgcgaaagatcgttcggggtgtcaataccctcgttctgcccgatggggttgcgcatgtagctgggcagtgcgctattgtcgatttgggtgacggtgacatcaggattgttatacggcagttcgttatacgcgtgaccggcaacgctgggcgcgttgtcagcggtggctgaatcggcggccattgcggtcggcgcaagggcaaggcctgacagcaatgtcgctgcggcgacgagtccaccggccaccgcgcgaaccgattgcgcggatacatggaaactcatagtgctcctcattgagtgagtgaaaagagtaatgatgggtagaaggaaaaggctagagccccctctgtgagggggctcactcggcagaatgactccgttgcgggtcaggccgagtggcgagccgaaccgtggtcgccggactggcgacgcttcaggatggtcacgcctgcggcggtgagcagcacggcagccgcagcaactacggaaaccgcggcaccagtcggaggcacacgatcacccttgttgtccttatcatccttatcagtgtcggtcacaccaggctgctgggagccgggcttctgctcaaccttggtggcccaaaatgccttgtcaagggcatcctgtgcggcatcgacatcggcctgcttggcatccttgtcgtcgtacaccttctgagcggcggcaatctggctctgcagagcctgccatgccttctcggtgtacttcgacttgtcagccttcttggcctgctcgatggaagccttgagagactccttcttcaccgtttcgacggcgggcttctcttccaaggccttgacggccttgttcagcgaagcggacgcttcctggacggcggcctgagtgacctcaccggactcatcgcccttgagcacaccttccgcagcctcgatggccttattcaaggcctcgacactcttatccgtgtacttgccggaagcggcctcggccttggccgtgtcgatggccgcctgcaacgtggacttctccacgtcggtggcgagcgcaacgagcaccttctggccgtcctcgagcttggtcacctgctcggcgacctgttcttcggtggcattgacatcgtcgtacacagcctgggcagcgtcaatgatttgctggaactcagcccatgaagcggcggtgtagcggcgtgcatcgaggccgttggctgtgtcaagagccgacttgagcgcggtcttgtcgaccggggtaggttcaggctcggtgccgtcaataccatgcacgccccactcggccacggcggccccgaaggtgctgctgccggtgtacggagtgagcacgagtcgcagcgacttggtggtgaccggcttgaaggtcacagcgctccaacccttggcatcggtatccgcacgagaagccggcgaattacgcacgacggtgtaatcctcggtgggctcgacgtccttccaagaaccatcctcggcgaggtactgaatcttccaagcgtccgggacttccagaccacccttcgaatcgtcagtctcagcgaagttggcccagaactgggcgcggctctggtcaatggtcacggactgaccgaagtcgtactgggcgtacatgccgtcctttgccttgccccaagaaccccagaccttgtcgttgacgttctgatcatccgtggtcggccaagtatcatcgacgactacgccgtcgttgagcttgccttcggccggtgaccaggtcgcctcggaatcaggcgaaatggtggtcctggtcgccttgccttcaatccaaccgaccaacggctcaggctcaggctccggagtggaggaaccgttcgggtcggcaaccacgtggacagtgagcttggcagctgcggaagatgaaccgtcgtcgacggtaccagccacctcgtagtcaccaaccttggtcaggtcgatggccttgatgtcggcatccttccacgtgaccttgcggtcgtcgttgtatccgttcgggaacttcaccggaaccgtggcgggcaggtcgatggacttggcgttctggtagacggtctgctcaaccggctgcgcattacccacggtctgcgatgcggtatcggaacgagccgcgatgtgtgcaaccgtaccgttcagcgcaccggcgacggtgcccttgacatcgaatacggcatcggcggccagctgagcgtcggtcaccttaccccacgtgacggcgaggtcacggcgagaaccgtcggtgtatacggcgctcacggtggatggcagcttcagatcatcagccttggaaccggtctgcaccagtcggttgacttcgtccacgctcaccggctcgatggcgtacgcctcgaactcggaagcacccacgatggcgcccttcgggaagaccacgcgcagcttgtcggtttcgacggcgtcggcgaacttcacttcgttgccttcgttccggttgaccgtgtaggactggccgtcagccagtttcacatcctgccagttaccgtcagcgtcagcgtactggagcttccaagatgagaccatcggcacgccaccgccatcggtccagaagaagaccttggccttcttcagcggcaccttgccggcccacttcagttgcagccacggctccacaccagtggagtcgccccagttgttccaggtctcgttcggcgtgttggcgtataccacctgaccgtcgatgaccttcttggcgttgtccttcggctggtagccgttggtgtagctggcagaggcgctcgactgcggggctacgttcacggtaccgtcagaggggatgccgtgaacggtgatttccttggagccttccttctcgccatcggaagcggtgagcttcaggacgtagtcaccctccttgttgaaggtgacggtggtgctggcagcggaggcgtccacgaacttcgcagtaccgccttccggaccggagacctgggaccatgtggtggtgacgtcgccttctgcgggcagaccgtcatccttcaccgtaccgacgagcttggcaccagatgaggtgctggaagacacgtaagcatccacctgcggagtctggttctcggaagtgccgtcagccttgataccggtgttgtaggcttcgatctccttgacaccgacggccatgccggcctgcggcgtgaaggtgacgcggatggtcgtggtctccaccggagtgaactggatacggttgtagttcgcgcccgcgtagttcggggtgcgcacctgatccgcaatcggggcccatgtgccgtcatccttctggtactccaacttgtagttggcgggctcggcatagccggagatggtctggctggacgagctctggtagaagtacaagcggatgtcgtcgatcttctgcttgccgtccttgaacttgatattgagcgtgtcggtcttgttctcagagcccttggtaccccagaacgattccatcacggtcttgccgtccaccgcgttcttggccgggtagttggtgtccttctcggcgtaggtggtaccggtcacgtccgcgtccttggccacgttcgtggtggacttggaggcggagtcgacgttggtgccggacttggcgaacaggtcggtcacgcgctgatcggcattgaaggtaacctgattggcggccttcacgttcttgacggcttcggcgccgacggtaacctgggcactggaatcgtccttgacctcgaccgttcccgcagccgggtcatagatgaggtgcgccagcttgtcggaggtgaaggcgagcttgccgcccacgtacaggctgtagccagcaggaccaccgtagtggctgccgtccttgtcccatacgatggagacatcctgatcgtggtagcgcaggttgtttaccgtgaagtagttccaaccggggatttcgatcgggtttagctcaatcttgttgtcctcgcgcggcaccataccggctacgtcctcgaccatcgtccagttcgtggtgccgagctgggtgtggtggatccaggagcggtaggtgatcttgccgccgttctgtgcggcgtcaaggttcttgtcgaggttgttgatcacgccgtcaccgttcacatcgccgacgttgttgttgtcctcgttccagaactcgttctgatcagggtagttgttatcgccgccctggtagtgcgcgaacgccacccagtacagcagcttcttgaactgctcattggtgatgtagccattcttggctgcatcgtagttgcgaataccggccgagtagacctgcagcagcggctgcgcattaatgatggagaagttgttggaaccggggaagttcaacgcggccttgtccgcttggttggcggtgaagaacgggaagatcgggaactcgttggaatcctcgaacaggcgcagagccttgttgtaatcttcgttgccggtaggcatcaggccttcggagtacgggtagtagttattgatctccttgtacttggcgaaagcaccgtcgttcagccacctgtgcttgagcaggttgtcggacttgtcccacagttcagtggtgacttctttctggatcttgtcggcgatggcctgcatcttctcggcgttggcggtatcgccagcagccttgtatgcctgagcagccgcgttagcgttggcccacatattggcggaaccatcggcgcgatccatgcgctggccggagcgacccggctcagagaaggaaacggcgtcggcatcgttaccggtcatcgaccaccaggaccagtcaatcaagctgttgtcattgttgttctggttgtcgttgttgtccggctcgctcttggaagcgagtagaccttgcacgtcctcggcaccctggtcggccagctcctcggccacggtggacggaccgccgtgcaccttgtaggagtcccagccggcgcgcgtgatgtactgcgtgtagctatggttccagttggccgggtcgcccggattgtcgtggtagtagtaatagcccgccttgctcttcttggcggtatcgccggcggaaagccaggtgccgtaggagtactcggggttgcggaaccacttggtgtccatcatgaacatgccggaggtgagcacgatctggttgttgtagccgagcacaccctcgatggaggtcgggtactggaaggtgttgccaggcatgttggcgtcgagcatgttgaaacggctcagccaccagcggtagaccacggtcttatcgatattgtcttccggagtgtccacgtagggagcgttatcgacccaccacttgttgtaggtggtcacggaatccttgtaggaggcggcagcatccttaaggtcgccggtgtaacgggcctcatattccttggtggagtcaggcagttcgttggcgatcaggccgagctgaatcttgacggtctgcggttcgttggccttgaggctcaacgtgctggtgagtttgccaccgctgacgatccagttggaaccgtcctggttgttggcggagaagcgcggatagatggtcgtcaggttgttcttgacgttcacgcggccagtaagttcggtggcaccatcagcaccctcggcggcgaacggcgaggccgtggtcagtgtgacatcgcggtcctgcgtgctttccacggtgaggttcgcaaccatcacgttgttgtaggtgatgtacttgacttccttgatcttgaggctcttgccaccggtctggaacagggaggtgaagtagctcggcgtctgcttgcgctgggaggcgtcttcgttaagggtctggtttgatccatcagcgtttacggtaacggtaaagccatccctgttggtctcatcccagtaggcggtgttacccacaaaaccgagctgattaggcgtgtgcgtgtacatgtaggcggcgcgaccacgggtgaacaggtagttgttgccgtcggagccttcatacgagtaagcacccttgtcgttcgtgcctttaccagttggctgtgcaccagtacgggtgagaatcttatcgatccagaagtcatggtcggtgtcggtgccggccaggttcttcacgtcgttatcgaatgtctcctgcagatagctggcggcagggttatatgtggtgttgttcgccgccgtcttcatcggatcatcagatcccttgaacgacggatatgccacatccgcattcttgatgacgggcgtatcggctgcctgcgcggtgactgcaccgccggtggccagtgtggcgaccgctgcaaccgcgccgattgacgcaagccaccgctttcgtgttgattgatgcattcctgcttggacctctccgccccggtctttcgcgtcttcgctcaggctacgtcgcgtctatgcgaccaggacttcttctgtggatgctgggccgcagagcccgttctccatcagtttcctttattggttattgggttcaccggaatgagtgtcttcagtaaatctggtgtgatatccgccatggatatcccggttggagcaattcaccgaagctgattccacatcataaccgagcgaatacggtttcacaactttccctcagtgatatcaaccatcttatacaacaaaaacccggtaatttctcagctttcgcatttattttcgcattaaagcattgctgcgtttcgccgtgtcgcagtacctacggcgcaacgattcagcctcgctgaatcaggaaccaacaggctcccgctggcgggagctggctcgcaaagcgagactgagggtggcttacacggtaccgcttatgaccgccctcagtcgactccgccgacacccgatgtctatttagaagtgcaacacccttgttggtcctgtaattctaacagttattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcgttacaatcacacggttccctcggcgtgtcgcaaacagcctatttacgctgttctgatatcagaataatccgttttgcattgccgatgcgtaacaaattcatgtgttcaacggcgtgtcgcaagaattcgattgcgtgaccatccaggttcaccttctcgcaaccggtcatcgcatatgcaaaaagggacttccctttacgggaagcccctttcagtagctattgaagctcgctagcctcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcgtgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcggccagtgcgtaggagaaacgcaggtaaccgggagcaccaaaggcctcgccggggacggcggccacgtgggcctcatccaacagtgcagcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgttcgaccagaacattgtcttccaccacggaaatctgggtgtgatgttccttctcacgcaccaccatcaggcggtccacgttctcgcggcgtgcgaggaaatcctgttccatgagctggctctggcggctgcgctcacggcggttgtcacggcggcgctgcttcttggcctcgagacgagtggagccctccacatcagtgatctcgtcgatgtactgctgcttgcgggagcggcggaccagcggctgttcgctgttctgactctggtcgtcggtgccctcgccgttcttgccgccacggcggcgacggcgacggcgagtaacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtgacgtcggattcctcgtcgccctcctcctcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatccttggaatcgctggattcatcggaatcgccggaatcggatgacttggaatcggccgcggtgctggcattgggaagcgcgggggcttcgaacagcggggtgcgttcctgcacttgcagttccagggaggcgccggcagcaccggtgccgcggaccacgcggcggccgccacgacgacggcgaacaggttcgacgggctgggaggcggcggcaggcgcaacgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgatagtcgagcccgtccacgttcacggtggccggctcgtaggcgttgagtcggttcagaatgtcggccgccttgtggatggcgttctcccccatccacgcgcgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccgttcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccttggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgctaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcaacgttgggatcatgagtaacgacgaccacagcggaaccgttgtcccgcgcggcggccatgagaatgcccatgacctcgcggccggtggcttggtcaagtgcgccggtcggctcgtcggcgaagaccacggcaggtttgacggcaagggcgcgggcgatggcgatgcgctgcatctggccgccgctcatctcccccggtcggtgcatggcgagtgcgcgcaaacccatacgttccagccacagaatcgccgtgtccgtggcggtgcggtagggcacgccgtcgagcatcattggcagggcgatgttttcgacggccggaagttcgggcagcagttggccggattggaagacgaatccgaagacattacgacgcagtttggtgcggtcggcgtcgctcatatggctcaggtcagtgccacggaagacgaccgtgccggcagtcggcttgataatgccggccaacgcgtgaagcaaagtggatttgccggagccggacgggcccatcacggctactgtctcaccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggcatcacgccggtgacgccgtgccctgcctgtgcgcgggccatgctggcggtgtagtccatgaccaggtcgtgcgcctcgatgaccggggcccactgctgggtgtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccagctcgtccaggcgggcggcgaagcggggccagtcggtcttcatagcggtgaggagcttgcggttgggcacgtcgtcaatcgggacccagcagatttccatgctttcgttgtcgtttgccttgggctcgacggtgtggccgggcttttcgaaggcaaacacggtggtgtaggcccacgggccgtggtcctcgcggtaggagccgactacctcgatgtcttcgggagtgatgttggcttcctcatagctttcgcgcagcgcgccctcgatgggcgattcgccgtccgcggtggcaccgccgggaataccccacgtgccgccttcggcactccacgcggcgcgatgttgcatgaccacgtgggtcaccttgccactcaccgggtcgcgacgagccagcagaataccggaagcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcctcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacgatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcgtgggagggtgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattgggttcatggttgttccttaaaaaggagctccccttgtcaggggagcttgggtattcagctttcaactcacgggcagccgttcgaccgcctcatcagagggagcctagacggtgtcagtccagcacgcgcaggatggacgggtcaccggtgacgaagtcgagcgcctgcacggccttgacggtgttgcgcagggtttcctcgtcggtcaggtgggtcacgatgcgcaactgctggatctcgccgtcgtagccggggtcggtcatggtgggcttcagatcctggttcacaccgttgatggagacaccgttcttggcgaactcggcggcgatggcggccagcacgcccggcttgtcgtggatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcaatcagggccgggtagacgcgggcggagacgccggcctcgccgttctcgaccacggcgagcagcttgatgaccttgtgctcggcggtggctgcggcgatgtcgtcggcggtgatcttggtgatgccctcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcaaactggagacccttggtggtcatctcgtcgagaatgtagttggtggtgccgttgacgatgccgagcatgctggtcaccttgtcgccgaccaaggactcgcgcagcgggcgcaggaacggaatcgcgccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcttggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcagcttcagcgagcgcggcggcgaacggctcggccagatcgcgcggcttcatgccggccttcttggccagctgcatggcgatgttggaggcccagtcgccatgtgcacggtccttcgggcgcatcacggcgagcttgtcgacgggcggaatcagctcgtcggtcaacgcgccggcttggccggcggcgacgaggttgtgggcaatgctggaaatcagttcacttaaggcttcaggactcattcttctaaggatactgagaacggcgacacttgcgctctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacactcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcatcaaccgagacaacaatgtgcaggacgacttcaacgaatccgtcatgaatcgcactgaccttaccgccctcgaaaagttccgcgtgctatggcggcattcgatgaccgagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgccgagctgctttcgttgctgccgaattattggctgatgccgtatttctacccggcgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatatgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcggcgccccggatcgcggcgacgaggagctgcccaccccacttgaagacctcaaggcaggcgtgcgattcctcatcaaggaccggccgaacgtgttcagactgctgttgttcgcggcggcgctcaactttgcgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgcgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccggtacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggctactgaacgtggcgcgctcggctacattcccgacccgcggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacaacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgtcgcgctcgaggcggacgggctgttgtagaacaaaatcgcggctcccctcaaagaggggagccgcggaacggccgaattagtcgaagtcggcgccgagggcttcgagtttgccgcggaagtcggcgtagcctcggtcgatcaggctgatgccgtgcacgtccgaggggccggacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttctacgctacgattcagggcaatggcatcagacgccatgtccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcggccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtgggtgccgtggccatgaaggcggcggctgagtaagacggctgtactcaccgcaaaaagaaaccccggcgtgatgggcgccggggagagaaaggagagaagaagaagaaagaggttaagttatgcagcttgttcggccgtgattacatataacagcaacaggttcaatgcaacatgggcactgtctgggaatcgtctgggaatcacggcccgtacaggctgttgcttgtttttggagccgatttaccggctggccttgatcttgtgggccagttcggcgtcccacatcgcgccggtggcggacatcaccgagtccgcgccggcgtcatggtacgcctggtagtcggcgggcgagaccacgccgccgacgccgttgatcgcgaaatcgagcccgagcttttcacgaatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgatcaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgtggaaagcggccgtggtgaaacggctgttgagcagcgggcctgcgggaatgccgaaaggcagattgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcgagagccagtgagacctttgtctgatgcgatgcgagcgacccaataatctcaatcagatacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctcaggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccgagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggatacgactcgaacatgacctagtcatgactcggttccgctccagacatgtctcttcggcatccacgaacgccctttcaacttcatggccaccctgtgagacacttccccaatttgctatttcactatgtgagatggcataatcgcccttattatgactgattcccaagaagagccattgaacaacagcttgaccgagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgagcgcgaagagggcgtgtgctcgatttccgccccgatccgcaacgcctccggccaggtcatcgccgccatctcgatttctgggccgaccggccgcatgggcgccgctcccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatacacagcggaaggcccccgaaaccccgaatacttcgcgccgcttcccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagatcctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaacccactgcggatgcgggggaagacacagcagaaggcacaacagcatcggcaccagcatcgtcaacgacgcccaacgtatcagccttcgcggtaatccccgcaccggagccagtggcaccagacggcgtctgcacagcgccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctccggttacgcgccaaagtccagcttccaccgtctgctggtggccccgcgcaccgtgcgcaccggtctaatccagcgcatccgccgcgaggaggacgccgcccgcgctggcaaggaggcctggatcaagatcaaggtcaactccatcgtggacgagaagaccatcgacgccttgtaccgtgcctctcaggccggcgtgaagatcgacatcgtcgaacgcggcatctgcgctctgaagcccggcgttcccggcctgtccgagaacatccgcgtgcgttcgattctcggccgcttcctggagcactcccgcatctacgccttctgcaacgcggacggcccgcagatcggcgagggtccggcttccggcccggaggtctacatcggttcggctgacctcatgcaccgtaaccttgaccgccgtgtggaggctctggtgcgtgtcaccgccccggagcaggtcgacgggctcatcaagtacgtggacctgcagatggccgactccaccatgagctggcacatgcagcccgacggcacgtatgtgctgcacaccaaggacgacgagggccgcccgctggtcgacagtcaggaatatctgattcgcaagcaccagcgccgccccaattcgcacaactgatttcattcgatgctccctgtcagcacgagctgactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcgtctccatcagcgaaatccaatattgccaccgatggcaccatcatcgcgaataccgcggattctgacggcaaggccacggcagcacacggcgcatcggacgcggcttccaccccggacccggcgcaggccgacagcccagccacagcggacaacgtactcaaccgcatcgaactgtgcatcgtgcatcgcccgaaatacgacgactggagctggccgaaaggcaaggtcgacccgaacgaatcgcaccggcatgccgccgtacgcgagatcggcgaggaatcgggcctgtccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggcgtggatgaaatcgccgaactatggagcgataccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcgccttctcctcggatgccgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagctgtcacgggcgatgcccatgactgagggagaaacccaccgaccgcaccccaacaatcagctaccagccaacaccacacctcccccggcgcggcgagccccatcgcaagctatactaagtatccgcgtcggaccgtgcttaagccccgggctccattttttgccgccgcgagcggcccttgcgccgacaggcgctttcgcggttcggcgcttcttttcttttacccgattcacgccccgaacgttgcgatgggcacgaccagtatgccgtcattgcggcgataggccttcccacctcggccggtaaggaacatcatgaactctggttcgcgaacttgggccatggggttgccacagattttgtcgcggaaggatttgagcttatccgcattgtcatcgttcaccttaaggtcactgagttttatttcgatagcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcgcgcatcagagtattcggcgcggcacctaaaaccgcagcagacaacgaaggatccacgaaatatcgcttgggcttggttcgcacacgactctttgcgcggagtggcggctcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcgacggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcggcagattcggcatccgcgctttccgcggcggcgagttccttctgaatggacggaatctctccgtacagaatcttcgaggcctccgccaagttgccttcacgggtatacttatccgcctgcacgcgcaggtcatcgagcttggcacgcaggtcgccgaccttgttgtggccggcctgttccgcatcccaacgcgccttgaggccgctgagcttctcacgggtgtccgcgagttcggcttgcagcttgcccagacgctccttggatgcaggatcctcggccttcttgagctgcatttcctccatttcaagacgggtcaccttgcgctgcagttcatcgatctcctcaggcgaggagtcgagctccatacgcaggtgagcggccgcctcatcgaccaggtcgatggccttgtccggcagctgacggcctgagatgtaccggttcgagagggtcgcggcggcgaccagcgcgtcgtcgccgatcgttaccttatggtgcgcctcgtaacgctgcttcaggccacgcaggatggcgatggtgtcttccacgctcggctcgcccacgaacacctgttggaaacggcgttccaatgccggatccttttcgatgttctcgcggtactcgtccagcgtggtcgcgccgatcaggcgcagctcgccacgggccagcatgggcttcaacatattgccggcgtccatcgagccttcggccgcacccgcgccgacgatggtgtggatctcgtcgatgaaggtgatgatctgaccatccgcattcttgatttcgttcaggacgctcttcaggcgctcctcgaactcgccacggtacttcgaaccggccaccatggagcccaagtcaagggagatgagcttcttgccttgcagggtggtgggcacgtcgcccgccacgatacgctgggccaggccttccacgacggcggtcttgccgacgccgggctcgccgatcagcaccgggttgttcttggtacgacgggagaggatctgaatcacgcggcggatttcctgatcacggccgatcaccggatcgagcttgccttccttggcggcggccgtcaggtcggtggagtacttctccagggccttgtacgagccttccgcgtccgggctggtgaccttcgcgccgccacgcacgccgggtacggccttgcgcagggaggctgcggtgacgccgttcttctccaggatttcggccgactggttcggcttgctggccgcgatgccgataagcaggtgctcggtggagacgtattcgtcgcccatctgctgcatttccttctcagcctgggcgatggcggcggtcagctggcggctggcttgcggctgcgaagtgctggagccggatgcgctcggcagtgcgaccaaagcgttacgcacggcggcgccgatggcctgtgggtctccgcccgcggccttgatgagggagcgcaccacgccgttttcctgacgcagcaacgcatccatgacgtgcagggtctcaacctgcgcgtttcctgcggcggacgcactctgaatcgcgtcgccgacggcctcctgggccatagtggtgaacttctgttccatatcgtattcctccatatcatgcggcccgcgcggagcggctcgcgggcttcgaaagccccgcaagcgccaccgcagaccgcaacttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccaaatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcgaatcagacttttctgcagctgcgcacgctgttccttggggatggaggtggaggcgagcgcgccgaatccggtggagataccgtaatgcggcacggtgtcgtcggccaaatgatcgataaccgcgcgactcagcgccatctcatgcttcgattcgtccgaaatcgccactttggcaccgccgcgcgctacggcgataacgtcctcgatgctcagcgctccaacacctacggtgaccgtctgctctgccatactcatacctttctatatatgtgccgcattccgcatatacgacatatgcggcacatgcttcgccggggatccgcgactgcccgcattcgctcaccgcacctgcccatcaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggtcgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttggttccctcagtcagcttctccgcctggacggttcccctcagagagggatccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtatagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccgaagccgcccccggatagggcgaattgggtgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgctcaacaggagtgaacgcttgagtgggctgttcgcccgctgcgattgcttgggttggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttggcttccaaaaacacaaaagcctgaaaccggctattgcctcagcaatattcagtcggtttcaggctaaatcgttaatcctctggcgaaacgacggtctacttcttcagtagcggtgcgacctgctcctcgtaggcggtcagggcggtgtcgattacgttgtgcatgtcgtagtacttgtacgtgcccagacgaccgccgaacacagtgttcggctcggccttggccttggcctcgtactgggcgtacaatgccttgtccgcatccgtgttgaccgggtagtacggctcgtcgccgcgttcggcgaaacggctgtattcctcccataccacggtcttgttcgggttctgggcatcgtggcgctccgggttgaagttcttgaattcgatggcgcgggtgtagggtacgtccgcgtcggagaagttcatcaccgggcaaccgaagtggtcgccctcgtcgtaacgcacctccttgaagtccaccgtgcgccacttcaggtcgccaagctcgtaaccgaagtaacggtccaccggacccgtgtacaccaccggcacgcccgcggccttcagcgcctccttgttgtacggctgggactcgtcgaagaagtccacgcccagcgaaaccgtgatgcgcgggtcatcgatcatgcgctccatccacttggtgtagccgtccgcgggcaggccctcccacgtgtccttgaagtagcggttgtcgtagttgaagcgcaccggcaggcgcttgatgatggccgccggcagctcggcagggtcggtctgccactgcttgcccgtgtagttcttgatgaacgcctcgtacagcggtcggccgatgagctggatgcccttgtcgttcaggttggccggatcggtgccggccagctcgcccgcctgcccggcgataagcttctgcgcctcggccggcgtgtaatgcgcatggaagaactggttgatggtgcccaggttgatcggcagcggatagacctcgccgtcatgcgtggcatacacgcggtgcacatagttcgtgaagctcgtgaaacgattgacgtagtcccacacacgcttattggacgtgtggaacaggtgcgcgccatacttgtggatctccgcgccggtctcctcatccatatacgagtaggcgttgccgccgatgtggtcacggatatcgatgatgcgcacgcgcgcgccggtgtgctccaccgcctgctgcgccaccgtcaggccaaacaggcccgcgccgacaattaccaggtcggggtattcagtagaactcaccatgcgcaataacctttcagtgtcaatctatcagttattatgttcgatttccgagagattatcttactcacccaactgcaaatcgaccaaagagcaatgaacgcctgcacagcatatctatatctgtttcctaggaacattcgcggagcaaagatcaagcacgcccgcgcaagcgccaaattgtgtaggcggcgagggtgatgccgtctgcgatgctgccagcggcaatcatctggtccatagtctgtacggagcaccatgtgaggtgcgacagttcccagtcatgtcccgcatccggcgtcacttcggaaacgttcagaccgaccacggcaatcgaatctttcatcacacccgtgtccgcatgcatacgttgcaacaccgccgcggaatcggcatccgcatggagcccggtttcctcatggaattcacgcaacgcggtttgctcgggtgtctctcccggctctcccatgcctcgcggaaattcccattcccatgattccgtggagacccgccagtggcgagccagcagcacgcgcccatcacgctccgcgacgcatactgccccaggacgagcacccttgaccgaagcataatgcacggcgaaatgattccctgtcgcaacgtcttccagtgccacttgggtaaccgcaaaatcggcaccgccctgctcttggtacatgaccttcttacccagaacctttagcggcggttcgccgtcatgtactgcgtcatcgcgaatcacttcgtcagccaccgcgccattggatataacaccgctcgatgccccgccatcgcgccccaccggtaacgcattaactaccatttcggcccctgccactttcgccattgattattatccattattcaccaaacgccactgccgcgaatagccccacgttccgcccacgatccacccacctaatccatggatccatagcagtgcgcacggccggtaacccgcggtctgcgaactaccgcgcccgcagcccacactactccaaatacaccacggtcttaaaactcgacctcacacccagcagccatttcgcgatatcgataagattcggcacaatgccgatgaaccacgccaccatcaccacgagccatatcggcgatttaccgttgaaccacacgttgtccgacaacgcagaaagcaatgccaacacacccgccaccaacgcactccataacatatctatgccgtcacccttcaggctcttctgctggcacgcctgctccaccgcataggccacattgcgcgtattaatcttctgaattcgcttgctcgtatcggcattgcacttgcgccatgcctcaataaccggctggctttgatagcagaacgtcgcaaacagcacgaacggcatcttgcccaactgcttggtaatactaccgttaagtaccagcgacgacctgctcgacctgtctccagccagccgtgcaaatgagttattcggcgcgctcaccgctaccaaatacgcgccaagatgctgcgccatggttttctggtacacgaactgataccagtctcgcaacaactgacgagacatttcaggcttctcgactttgcctactttgccgaccgacttaccgaaccatttgccagtcgacccatcaaccgactcatcaaccgtctcttcatccgtctcggtttctcgcagcgctggcttgccttccggcagttcaaccgccctatcaatgcacatacgcgcatcagtacgcttcggcatcttcgcaatcgcctgcaatgtctgtgcaaacgtcaccgtcgtatcattgccgccgctcgaccccgtattcgccgcgcccgccaagtcccgcaaatggaactgtttgcgcaatacctccgcacaatcgcgcgcattggcttcaaaatatgggacgaaacccttacttttcgtcagttctttgaccgaagcatcattctggttctcgtaaagcaccagaccctgtttttccgcgtcgatccattcctgccaacgttgcccgaggaaccggcaccgatcctcaatagccgcgccataccagtcactcgcatcaccgtcagcttcagcaccgtacagcaactgtgcatacatctccgcgatgatggttgacttcagctctcctgtttcgtgagcatgtttcagccgattggtgaactcggtatagaaccgactatttagccccagcgcttgattccacgtgaccgtggtgccgaacacacagtattccagcggccgaacggtcagttgttcctcagttcccgcacacacaaggtcctcgggaagaatggtttcgttttcctgttccgctgccttttgcgcgtcttctttcacgtcttcgatgctcttagtggtgaacgccaccaagcagtcctccagagtcggatgccggccggagacgatgatcgccggaccatccttatacgactttcccagcacgccattgaccgccgtggggccgagagccaagaagaacagaccatccagcaactgcgcttcggtcagcatgattttggggcaatacatatatgcggtgcgcacaatacccgcaaaatgcgttgcgatgtctgtgtagtcgttgagcaaccgctcgcaggggcgatacgtatcggtcctgcaccacagattacgaatcgatggatacgcagggtactgcttcacaaggtcattccactcttggctctgctcagtggaatcgaagttcgtgatcatcgttgcccgtagcgattgcctcttgcccatacgcctagtctaggcacatcattggcgcacaggcacattaccatctcgtgcagttgctagacgagcaattagacaccggggtaaaaatcatcagatatcgatgccaatgcatcaatgtcatattctctcatggttgatgaatattcctctcccagagggaattgcttcgaaatatcaacagggcttaacccactttttcgcatcaacgcacgtttaaccaaataagcgaaacgtgggcattctgcacgggtcaatcggtcggcaaaatcgggaactccgtcgggacattttttagaccaatactgcaactcacaagtaacagcttggtccaacagtactgccgacgactcagccaaatcacagaaaaaatcatcggcagtacatacggagtaaggaaggccatctaactggctctcgtcaagcgatgcatacagctttcgatcattcgtcagcaacaccgaacaatcattatctactgcggcagcatgaagatgcaagtcgtttggatccgcgcccatgtaatcagcttgtgcccgctcacaatcatagtgatccacgacatgaaccagttcacgtatttgattaacgagaccgtttacctcatcgccggaacgtttcggattgcttcgccgatagtgataaacgacttcagcgaatacgtcttcactggagaagagatcgaacatctgaatcttgctggtcgacagagcgaaaagccaatctcgaatagtgcgagaatacagaatgttcgcatccacaaaaacgcgttccatcccgacatcccttcgttgctgacttgttcagccacgaatataccactcagacttaatcttccaactcgtccagagaaccacgcacggcaaggaaatgctccctcttaatttcctgttgcttgtctctgtattcaagaacatcgttgagcaggaaacgatgatgagcgcccaccttatgagagggcagctccccttcacgaaccaatttcaacaaagtgggtcgagaaattccaagcatttccgccgcagctgtggtccgcaattcctttggtgtggttgaaatgaccacacgagagcccttgctcagactctccaacacggtcgtcacaatgacagaaacatctttaggtaaatctacattgcgtccatcaacattcaacgcgatatttgcacggatatcttttatatcgtctacagtttgttcgatatcacgctgactctcggagtccaccagaatagtaagctcacgatcacgagacaaaacttccataagtacactcctttctctctttgcactcaataagcgtgaagacaaaccagtcaggctcggcgcgctttacacttacaactgaaagttacacttgtaagtgtaaagcgcgccgaggacatttgcgcggtatttacaggaatacgcctacggctaaaagaggtaaagaattaccgtgcagccatcaaatacaaatatattctgctaccgcactcatgcaagcctcaggttacgatgagtggctatgagcaattccgcacaggcctccgattcagccaacgaagcagccaacaacccagccaacggaccatcgtttatgccgcagcacattctggtaaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaaccacgcaagttcactgaagacagcccgtacaagccgtcgagcccgtattccgcttcgaaggcggcaagcgatcatctgataagggcatggcaccgaacctacggtgtcaaggcgacaattagtaattgcagcaacaactacgggccgtaccaacatgtggagaagttcattccccgacagattacgaatattctcgcaggtatccgtccgaaactatacggtactggttcggcggtccgtgactggatcagcgtggaggaccattgcactgcggtatgggcgattcttacgcacggacgaatcggcgatacgtatctggtgggggcgaacggagagatgagcaacatcgatgtgctgcgcatgattctggaatgcatgggacagccgtcagacgcgttcgaccatgtgaacgatcggccgggcggcgataaacgctatgcgatcgatgcaacgaaaatcacgcgtgagcttggttggcgtccccgattcaccgatttcgccgaaggacttgacgagacaatccaatggtaccgggaacatgaggactggtggcgtccggataaggacgccactgaagccaaataccgtctccaaggccactgagcgaggccccaaccggaagagttgtggagcgttcgccgtgtattcgcatgcggcaaaggccaaaagcgaatacacggcacgcgactcagtccctgcggaacaggtcccttgtgtagaccttgcccgccacgtccgtgaggtcatcgttccaacggttggagatgatcacgtccgcttcgcgtttgaacgagtccaagtcgtgcgtgaccttgctgccgaagaaatcgggggcgtcgagcgtcggctcatagacgacgacctcgatgccgcgcgacttgatgcgcttcatcacgccttggatggcggactgacggaaattatcggaaccgctcttcatcgtcagacggtatactcccaccacaggtttggcgatgccgttcgccttggcccggtcgacgagctcctcgatttcgtaggcgatgaagtccttacgtgtgcggttcgactccacgatcgcctcgatgaggttctgcggcaccttatcgtaattggcgagcagctgcttcgtgtccttcgggaggcagtagccgccatagccgaagcttgggttgttgtaatcgtcgcggatacgcggatccatgcacacgcccttgatgatttcgtgcgtgttgagaccgcggctttccgcatacgtgtccaactcgttgaaataggcgacgcgcaacgcgagataggtattggcgaacagcttgatcgcctccgcctcagtggtaccgaccaccagctgggggatgcccctcgacccatccgggttgacgcggtccttctcctccggggcggcaccgtgggcgagcaggtccacgaacgtgtgcgccgcctgcacggcctccgcatcatcctgcggcgcgccgaccacgatgcggctcggatgcagattgtcgtacagggcgtggccctcacgcaggaattccggagagaacaggatacggtcgtcgtggaaccgttcgcgaatctgctgggtgtaaccaaccggaatcgtcgacttgatgacaatccatgcggtttggtcgtacttgcggatcgcctcgatcgccgcctccacgctggacgtgtcgaagtagttcttctgggcgtcgtaattcgtcggcgtggctatcactgcgtaatccgctcccgtatacgcctgttccgggtcgagcgtcgcctgaaagtccaacggccgctcgccggaccggtccgcatcgaggaatgcggtgatcttgctatccacgatggggctcttgccgttgttgagcagctcgaccttctcaggcacgatgtccaacgcgtgcacctcattatgttgcgacagcagcaacgccaccgacaatccgacgtaaccagtaccggcaaccgcaatcttcacgggacactccttctacgatgcgctacacgcaattctaactacgattagtgcgatgcgcagtcgcctgctactccttgccgacgcccaagaggaacggactggccggcagattcaccgagttgtacagcatgctggagctgttcggcgcaagaccccacaggtaacacacttgcgagatctttgtcacctcatcggaatgaacgattaccgtattgccctgtatagaagcgtcagcagtataaaacacgccgtcctggccggcgacctcgaagccttgaagtgggttggaagcactcttgacgagattcgttgccgtcgccttcgtgatgtaattcggggtcattgcgcgcagtccttttgctgtgccttccgcgaatgtcacagtaccggtggaagcgtcttcctccatcgccgatgcccgtcgcgccaacggtccggacggcaccgtcgattcactcgattcccttgaatcggtcatcgccaaccattgtgtcgccatacgcgcggcgagaatgtctttgccaagcggatggatgaccttcgacgtacctttgtccgtgtcgatcgaaacagtcatcgccagatgctccgtcgtgttcactgccgcactgtccagcacgtcgagctgcgcctgccgaacgatgggcgcgtatagggttcccactcgagtatcgtgcgagctgtacgcataggaacggcaaatcatcttctccgaataccgcacggtactggttgatgagcacggcgaaattacttttcatagcgcagcgccgtagcttgggtggcagtatcgtcttcgccttggtgccacaacacgccggcgacacgatatccggtcagcggtatgacgtggttggcgtagatactgccacctttcatatgcagtgcgatgccggtgccaccccatgaaatctggatgataccgacaggcacattcggatgtttcgcccgcagttgcgcggcgaacagttgcggcaggtaaccgagatattgcgcgtcggagccggtcgcgggtgcccatttggtcgcgctcaccgacctaagcggcagcgtgacgctcagtccgttggcggatgatttgttggagccgctggcttcggccgtgccggatgcggcgcatcccacaagcatggtcataccgacgagcaacatgatggcggcgcacgttcttcgcgccactgcgagcgctctcatacgaaccatcacgtgggggcaacgcacggatagcatcacctgacaagctgattcttccgttcatgatccaatcactcattcgtctgccgatttgtatactgactggtatggtacaggcacaaacttcaggttcggccacgacgttcggcgcggcctccacagcccagcaaaacacgtcggaaacgccggatgacgcatgctgggaaacggtgaacagggtcgtttatcctttgcatgatgccgatcagacgatgccgttgtacgcggtgaactggcatcccgcgtatttcgatccgagcgtgttcgacgagcgcgagaatctgtacagtgcgaatccgaacggcatgacgcgttccgagctcgcgcggctcatcgcacaggggcggcgtacggcgagcgaggagccgcacggcttcgccgtcgattcgcgcaatacggtcacattagcggcgggcacgcacctgtcgtgctgcacgtacttcaacgcgttcccagccggatactggcggtattggacgcgggtgagtaacgtgcggttctccgcgtggatgtcgggcaagggcacggtgaccgtgttccgttccacggcacgcggcctggcggcaccggtgcagtcgttctccatcgacacaaaacatggcgacggaggcacgcagcgcgtcgaggcgttgctttcgttgaaaggcatgctggacggcggcttctactggttcgacgctcgtgcggacgaggatgcgtcactgaccgtgggcggcgcggtctggcaagtgccggcctgtgaccgtcgcacgccgcagccgggtacggtgtccgtggcgattaccacgttcaaccgtccgtcgtattgtctggaccagttgcgcgcgattgccggagagccggagctgcgagtccggctggataccgtgtactgcacggatcagggcacagatctggtatgcaatcaggatggtttcgccgcggccgccgacgatctgggcggtcagctcacgtatctccagcaggcgaatctgggcggttccggcgggttctcgcgcggcatgttcgagacagtgaaagcgggacgcagcgactatacgctactgctcgacgatgatgcgatcagcgaaccggagtcaattctgcgcgcagtacagttcgcggactatgcggcacgccccgtgctggtgggcggcggcatgttccatatcgaccacaggacggtgctgcacgtgcagggcgaacgattcgacccacgttcgatgtggatgtacccgtcgcgaggcgcggagttcaaccatgattttcgctcggaaccgttgtcggacagcccggccctacacagcgtgaagttctccgatttcaacggctggtggttctgtctgattcccacggagacgatgcgcgccatcggtttgggtctgcctgcgttcatcaagttcgacgacatcgaatacggtgtacgcgcgaaaaagcatgggttcccgacggtgagtctgcccggcgtggccgtctggcatatggggtggcacgacaaggatccggcgcgtagctgggaggaatacttccaagtgcgcaatcggtgggtgtgcgcgttgctgcactatccaaatgccggcaaagcaagcgtgtttcgcatgctgtatgaggaagcgaatctgggactgcgcatgttgtattcgggcatggcgttgagccagatggccctcgccgatgttctgaaaggtccggcgtatttcgtggattcgctgccgtcgaagctgggcgaggtacgcaaggcgcgttccggtttcgcggacagtaccacgttcaccagcccgttggatttacctgagcctggcgatcatgccgaacgcgactgggcgccacagagcgcacgcgatgtgacaaagcaaggtatgaaggctgtgttcgctgcgctgcgatcccgcgtggacggttccaaggacgaggccccacaggtggcggttccggcacggttctccatctggccatcattcatcggcgtgcgttccgccttggtcacttcagccgatggggattcggtggcatggttccgtcgcgatagcaagctctaccgccgcaacatgcgcgtgtgcttcggccttgcatgcaaacttgctcgtaactggaaacgcctgtcacgcgaataccacgaatacggcgtcgcttccatggacacgtgggagcacatcttcaaagaagcagagtagccggaacgataacacggtgagaataggaatgcccgttgtctttggccacatcggagaccaaagacaacgggcattgccatgtcaaccggtcagttcactctggttcaggcttcaggccgctgcgggaaatcgaccttcggattgaacgtgatggccttgagcagctgaccgtagatcttgcgacgcaacggcttcgcgacgcggccgcggcgcatggcgttgtgcaccacgagacagaagtagaggtactgccacacattcctgtgatgcagacgataggagccttcgttgcgggcgccgtaggagaacttccacacgttcctgtcgtttaccatggaatagttgacgccttggttcatgcccatgtcgtgcagcacaatgctgtcagtcacttccacgccggggcacgactgtgtgatgcgcagcgtgtattcggcgtcgtcgaaccagatgaagtactccttgtacggcaggccgaacgcctccatcacccaacgcgggatgagtacagacacgaacgagcaggaggtgaccatgaccagattgtcgtagcccatggcctgcagacgtccccaatcccaagtagggatagggttgttcatttcggagatggacccgtcgatgaacttgaccatggagcacacgtacggtacatcggtgccaagtccggcgaccgcattgtcatagccttcgagcagcttcgccagagcggcgggctgcgggtagccgtcatcgtcgaagatccacacgaagtcggctccgagttcgtagcctttgcgcataccggcggagaaaccgcctgcaccacccgcattctccgtcagcgtaacgatggtgatacggaccttgtccttcaacgtgaagtcgcgttcgtattcggcaagatatgcagcggtatcgtccgtggaggcgttgttgacgatgacgagatgctcaggcagtcgcgtctgtgcttccagtgatgcgaggacgttcttgagtttttcaagacggttgtaggtgacgacgattgcggcgaccgtagaggtatttgcggatggcatggctatttgttccattcgttgagaagctggcagaacagactgttggcggtttgtttgtgtgagaaggtttcaaggcggttcttctcgacctcccacagtttgtggcggtccatctcattgccgttgagatgcatgagcgcacgtttcgcgtcatggatgaacgaggaggtcattcggcgcagcagtccctgcgacggcacgagggtttcctgagatccgacgttcgcggagagcacggggatgccagcactaatggcttcgattgtggtgagcgtgatgccctcgttcacggaggatacgagcagcacgtcggcatcggcgtaggtacgcgataccggaatgctcatgggacggcgttcgatgacatcatcaaggccatagcgtttgatgagcccatcggtgaagctgtccatatcaccactgccgtgcatgatgaaatggtattggccgggcgcggcctgcttcattgccttggcgacgagaatgaacgcgtcggggcgcttctggcgggacatacggccgacgaacgccacgttgaacaccctcgggtcgcggcgttccgcatagctcacgtgttcggagtcggcggtgagtccgacgagaggcgcgtcgacgactttggaggcggggatgtggtggatgtcttccatccagcgctccagctgcggggagatcacgtgatgcaggtcgatccactcgtcgtgcgcgagcgattcacgcgggaagccgccttggaacatgtattccacgatgtgcagcgaatccacgatcttgacgtccgggaagtacttcttcacccaccaggcattgtcgtacatccactggcagtggtgaatcatgatgccgcggatgtcgaactgttcgaacagggcgcgaagaatcgggacgtcaccgacgcggtactgcaacggctgagtcaggggaatcacgagcgcgccatcgcagatgggatcagtgatccatggttggtgaccgtcggagtcggtaaggacgatgggcaggaagcctgcttctttggcgagctgaatggtttccatgccccagcgttccgcacctccggcttggagccagtgcatggcgacgataacggccttgggcgcgtcgagaattcgagtacccggcttaatctcaacccatggatgatggttagcttcgctggcattcgccgcttcaatggtgagcggctcatacagtcgcacattattccgagccttccgctctcgttccgctcgttgcagttcacggatacggtcaaaggcgacgggccagcgatattcaagttcgttatacagtttaacggcacgactcgcgttgggcgcatgttcccagatgtcttcatctgtagcatcatccggcgtgagcaggatataacgatcattgcgatcgacgagctgctcatccccagcaaagtagtgaggagagaataccgactgcgcgttcacggtagaagtggcatcgaactctccaatgggctcgcgcccatcatccgacgtacatgaacctccgagggtggacgtatccgtcagacggggatactgccatttctcacccatgtaaatccggtagtgtaaggtccggccgggttgaatgagtgagtggtagttgaccgccgccacaacaagtttgcgttgacggttgctcagcgagtccaaaaactcacatgcgtcttgatctagttgagagaatcggcacatgagtttcattgtacgcacgcggggcgaagtacgaccatctactaccggcacacggccgacgagctcgacctgccggacgagctgtgggaactggtgcgcgtcaaggccaacctgctcaccccatccaagaaacccatcgctcgcgacagtgaacccggccaagcccgtccgccgcatccacgatatccagaaccggctcgagaccatggccgcgccacgcaccgcaaggctggccagacgtacgggcccggacatggcatacttgaacaagacgctcgcagggatcgcgggtgtcgaaccggaatacaacgaaacccccacaagccgacaaggaataggattacacgctcactttccgatgaggcactccgaccgtgcagcttaagtggaacttactgcacagattcatcttgcttcatattgctgacatagccatcaaaacgattagcaaacaaatccggagaatccgaataccatctattgaaataatctttcaaagtcataatatcttcggcttcaataggggacactctctcataaacatgaactacgacagggccgtcaaactgaaacgatcgacgttcaacataatgacgcccaagaaaactagaggaatcctgcaccagactattgagtgcaacaacaactctttcgttctcttcattcatgtgcaaggaaactggagtagatgtaacaacaaaacgagcatcaaagaattcagtattaaaaccatcacgcgaatcgacatcagctgcaataacaggaaaagctgatcctactacatccggaagcaaagtcgtatcggcaagagaatagtttaagttagcactcgcagcagcaaaatataccgcttctccattcacggtctgctgacgaaggtatgtaatcaactcacgtttctgcgtaacatcattttgcttgataggacgaactacactttgcttacccagcagaagactaatctgagaaggaacagacacaacagaaaacccttgcaacaaggaaacgactgatagagcaactactattagattaatgacagtgcgcacatcaccattcttcaacagatttacgcatgaaaagaatggaaccgaagaaaaaatttcaataaaaaagagaataacataccaatgctgttctccaaagtcctgaacatgccagaataccacagaggacaacacagcacccagaaagacagacacgggtaaaataatagactcacagaaatctgttttattcaaaaccgatagacgagaatatacgatacacaatattacgacactaattaaaccaacaataaaccaaagcaatccgattctgttgacgacattaagaatcttggcgggataagaatcatagacagtccaagcactataggattgcgagtactgacctccggcggatctaaacacaaaaggccgaaagacggacataagaggaagcgcgacgacaatagccaacgtggccacacggaagcataacaatttaaagagcgcgatgcgaccggcacttgcatttacaacaatcgcacctgtccaatatatcaaacagcataaaaccatcccaataacaccgaagataaaccaccttctaagcaaaaacacaccgcataggcctaagccaataaaaatagccccaaaacgtctctttgggaagtttacatccatcaatgcaacaagtaaagcaataaatagaactgcgggtacggcatcaaaatagcctaaaaatataggcgcaagaaacgagggagtaaacaaagagaaagcatacgcggcaacaaaaactccagacgaaccattagacacactcgaacccattgatttggatacgatgaaccctgccataagcaatgcggctggaacggcagcaatacatgactcaataaacacagcccccttccatgacgggaaaagatatactgggaaagacataatccacgacaacagcaaattataatccgagtaattcacactgtagacaacttgccgaaaagtatccacagctccattctgcagactgcgattaaagcctaatgtattgttccaataattggcgtaatcccatatgggaataaagttatattgagacaagtagatgccagcaaatacaagaaagacaaaagtaaggacaatcagagaaattgccgcacggaactgtaattcaacgacaactttcaacgcctgagtattacgcactattaaatatacaataaagtaaaatccagcaatgccgatcatactcaatgcaataaatcgtccttcatgaaaggacatcatagagacggcaacgccaactagtgtcaacactgctaaaaaagctcgattattgatagccagtttgcctgcaatcatcttcatttctttaccttcgcatatctattatatttcacttacactcgcgaaagaagcaccttttctacggggtgcacaattattgcatcaattagccaagaaatgcaacttagaacaataaacacaataacgataatacacactcccgccatagggcgtagaataggcagagagggagggtaactcattttcgagacgcaatcccatacaatgcgaaatccgaaccagttctcgtggatgaggtagatgccgaaagtggtaggcgctatggtacagatagctctctgcacaacctccggggattggttcatatcgacacggcttaccatgatgaacaccaacataccgatgatgatggggaagagaacaatgccatcatgaatccggtttttccaccccatgaaatccaccagccatgattgttccgatatgtaatggttgaacgcgaccatgagcaacgtcaacgctacgattattccaatcattgggagagttctgaacctatcctcataatcttgataatacttgcgcaaccatccgcctatcagatatcctaacatagcatagacgagattgttccagttcgaagcacgttcgaagatgagaatctgaatactgaagaaacccagtagcacaatcaacatctccatggaacgctttggcaacgtattaaacagtgtattgagatatggtgcgactaaaagcatcagcaggtacgcaccaatgaaccagtaactgttgtagaagaacgggaataaactggccagtatcgaccgatacaaatccaccccatgcattatcggctccaccgccataggataatgatggaatgcacccagtaagagcacgataatgagaaaggccacggaatagcagaacatctgcaaccaagtctttaccaaacgattccacttgaacgacttctccaccaggaagtacccggagatgatgaagaagatggatacacccacctggccgtactgcacaatcacgaatcgcaatgccgaccaccagccaggctcttgtggaagaaccactcgcagctgatgatggtcccagtcgaaatgaataacgaaatggcacgtcagaatcaggaacatcgcgacaatgcgcaacagttcgatggacacgttccttgcggcaggtttttggggcatactagttccttccctcgcccgcatagtcgatcatggcgatagatcgtccatacgtcgtctccagtaaatccgtacctaatatagggggaaccttcgaagtgctgaccggctgcaggggtatactgtccgcatattctgtcctttcgaagaagcggagccggcgtggaagcagtatcatcacccccccttgtttcggtcatcatccccgcgtataacgcgcaggagtatgtcgccgagtgcgtgacgagcgtcatcaagcagactgcgaaggacatcgaggtcatcgtcgtcgatgacggttcgaccgacgatacccgcgaaatcgtggcgtccatcgccgaacgggatgctcgcgtcacgttgctcacgcagtccaaccagtacgccggcgtcgcccgcaacaacggcatggaccacgccactgggaaatacctgtatttcctcgatgccgacgacttcatcgaaccggacacgctggaaacgatgaccggcatcgcggaacgcaccggcgtggatatcgtcgtcgcccggtcgaacagccatgatgccgagacccatgaggaagcgctcatcgactacaccatcaaggacatgtcgacgagacaggtgctgcataacgcggattacgcgggcaccacgttccagagcttcatcggatggccgtgggataagctgttccgcgccgatttcatccgcgagcgcggcttacgcttccaggcgctgcgcacgacgaacgacgcgttcttcacgttcgtggcgctggccatcgccccgtccatctactgcacggacgcgatgctgttccaccaccgcacgcacaacgccacatcgctggaggcgacgcgcaggaagagctggcagaacgcgctcaacgccgtcacgacaatcggcgactatctgaaaactacggataactacacgctcaccaagcgtagctacgagaactgggtatcccacttcatcttgtggaacgtgcagtcgctggaacgtccgacggcggtcacaatgatggacgcctcctacccgctgctggaggcactgccagacgacaaggactactactacgaggaacgcgactatcgtttcgtcgaactcgtgcgacagacccgctcccagctgattctcaccgcgttggacggtgattggcatgtcggcgacctgtggaagcaattgtgcgaaacccgtgattgggtggaggtgttggagaaacgcatcaccaaccgcgaccacactatcgaggcccagaaccgccagattcatgatcttgaccggcgcgtgcgcagcatctaccattcggtctcgtatcgactaggtaacgcggcgatcaaaccgctttccatcgcgaaggatttgctcggcaggaagaagtagcggcgcaagccccccacatacccgcctcccactagaatatgtgagaacgctgggcagagacactggcggcagacgccatgttgtctcgcatgagtaggataggacgcttgtgaaagacgtgatcaaacgcctccaggagaggtaccactatgcgctggtcgtattcaaggagctggtgaagaccaacttcaagctgcgctaccaaggctcgtatcttggtgtgctgtggtcggtgctccagccactgatgctgttcgccgtcatgtacgtcgtgttcgtcaagttcctcaagttcacggacggcacgcccaccttcccgatttcgttgctgtgcggcacctgtctgtggcagttcttcaccgaatccacaagcatgggcatgcgttccatcgtggaccgcggcgacctgctgcgcaagattcacttcccgaactacatcatcgtggctgccaccacgatggggtcgatgatctccctagccatcaacctcggcgtggtcatcctcttcggcttcttcgcgcacgcgcactacacgtggcgcgtgatcaccgtgatccccagcatcctgcagctgtacgcaatctcgctcggcgtggccctgctgctcggctcgctgtacgtgtacttccgcgacatcgaccacatctgggatgtcatcctgcaggcgctgttctacgcgacccctatcatctacccgctgtcgatggtgcagaagaacccggagttcagctgggccgccgacttcatgatgctcatgccgaccacgcagacgatcatggacatccgccacaatctgctgtcgccggaatacgtgccgaccatctggaccgtggtggacaacaagatcctgtgcctgatcccctacgtgctgtccgtgctggtgctgtggctgggcgtccacgtcttccgtaagtacagcgccaagttcgcggaggtgctctgatggccgacaataccatcgacaacacgaccaacccgactaacccgaacgacgaccgtcccgtcgtcctcaaggtcgaccatgtggcgaaatacttccgcctgcccaccgaacaggccacgggcttgaagatggcgttcctcaactggacgaagggcatcaagggattcaccgagcagcatgtgctcaaggacatcagcttcgaggtgcgtcagggcgacttcttcggcatcgtcggacgcaacggttccggcaagtccacgctgttgaagatcatctcgcaaatctacgtgcccgaaaagggcagcgtgtccgtcaagggcaaactggtgccgttcatcgaattgggcgtgggcttcaatccggagctcaccggccgcgagaacgtgtacctgaacggcgcgctgctcggcttcacccgcgaggagatcgacgcgatgtacgacgacatcgtcgagttcgcggaacttgaggacttcatggaccagaagctcaagaactattcctccggcatgcaagtgcgtctcgccttctccgtcgccatcaaggcgcaaggcgacatcctcgtgctcgacgaggtgctcgccgtgggcgacgaggcgttccagcgcaagtgcgacaacttcttcgcgcagatgaagaaggacccgaccaagacgatcatcttggtcacgcattcgatggacgcggtgaagcgctactgcgacaaggccatcctcatcaaggacggcgagattgtcgtctccggcaacaaggatgatgtggccgaccagtacacgctcgagaacctcaaggtccaggaggccgaacagaaggctcatgccgcagccgtgaacgctggcaccgaatacccggccggcctgagcgaacgcgtgcccgtgctgaacgtgcgcgcagaggactcccagctggtgaaaactgcagatccgttccggttccttgtggattacgagttcaatgaggatgtggaattctacctgacgctcaccctgctggacatgaagcgcggcggcatcatctacgatacggccgccgacctgcatcagacgaagcgcggacgccagaccgtgacgttcgagctgccgctcgacgcgatctgcaatggcgattatcgcctcaccgcgcagcttcgttccttgcctgacccgagcaacatcaagtcgaaccagcagcttgcctacacggacgaaagccgctcctgcgacttcgccgtgcgtatccccggcaacgagggctacggcctgctgaataaaagctcgatgcaggtgaagcagctggactgattcaggcgagttttttcgggggtgtcggcatcatatgatgcgtcgtgtgacgccgtcatccccaccaccaaatacgttaattacaaacatcagagaggatgtgtctccatgcattggagcaaaggaaagaaattgctagtacgatccctgtgtgttcttactgctagtagtctgatggctgcccccgcttatgctgcttctgccacgtcaatcacccgactggacggaaacacgcgctatgagacgatggggcgcgtagtacaaacagcgttcccgaaacaatccgactatgccgtactagcttcaggagacaacttccccgatgctctggctgcttcctcacttgcaggtgcattaaaagcacccatcattctgacaagctccacgactctttcaagcgaagcaaggaatgagcttcaacggctagaagcccgaaccgtagcaattgtcggaggctcatccgccgtatcgactgccgtcgagaatcaggtgtcccaaattgtttcagacggaacggttgttcgattctcaggagagactcgtatcgaaacagcattgtccatctatcgcaacgcgcctagacaactccccgtaacatggtcccgaacaggcatcgtgaccacatcatccaattttgccgatgcattgtcgatttctccatatgcctattccacagcttctccgatattcttaacagacaagaatggattggaaccagatgtacaacaatcactctctcatttcgacttcgataaagcaataatcgttggcggttctgcagtggtgcccaatatcgtagagatccaactgtcaaatcagcaactttcaacaacaagattgtctggcaatacccgctatgataccagcaaccaagtcggacgttttatactaaatgaatctgtatacactccgagcaacatagtatttaccaccggagagaatttcccagatgccttggcgggaagcgctcttgctggcacccgaaacactattctattactagcaggcaataaatattctcccaccataccgttcgccgaacaaaatatttcttatcctcgaaacatttatgttttaggcggtaaaaatgctttcacctcaccaactatcaactttatttctctgcgctatggccacggagagatagaaccagatccaagtgaatatgtgaatgaaagcggagtcacgcctggcgcgtggtgcaaaaagagagatcgcggaaagaaagcactcagcaaacatggaaccgtgatgatctgctcggcagatccagaagatcccgacacatatcgttggcgtgagtatactggctggtaaagttaaaggacatgcctcgaagttcgactcacactggtactgttttatcccaagtttctgctggtagcactctggcgttcgcgggcgtgtgatgaagcaaatccataatttcaatacgcgcccgattattcattgataaagttcatagaagctgatatactctttcaccacgcttaagaaagcattgagctgagtagacactatcccatatgcttatgagcatgagcatagatattcgcgcatggttctgggagtcaaagaacagggtacgtcggacgacaacgcaccttggacgacggattgccagcaaacaacgcatcatcgcctcgttgacatcatatccgccacgtatggccactattcatctggccatacgctccattcttgcgcaacgcacactacctgacaaagtcgttttatggctatatgaaggagacttcccaaatcgggaagcggatctccctgatacactcatgcatctcatcggacatgatgttgtaatccgatgggtttcagaaaacctgaaaccgcataagaagtactactgggcgctacaagaattctcaaaagatcttgtaatcacattcgacgatgacttggtatatcctaatacctatatttccgagcttatgaaggcacatcgggcgcatcccgaggcggtaatcgccgcgcgcacgcatctgatgatgttcaacgaagatggttctctaaaaccttacgaccagtggatttacgaagctcccgcgcgttatccctccatggtgaataaaccatcgatgcgtctgttcgccactagtggcgccggaaccctgttccccccgaatgtgatgcctccagagactttcgacatggctgcaattcgcgctacagcgttgaatgctgacgatgtttggctgaaggtcatgcaggtcattggccatgttccggtggttgccgctaccgcgaatcagattatcgccaatattcctcttgctgaggcacagacacggaatcgccttgcatacgttccagacacacaagaggaagcactctgccacgccaataccgaggcaggcggtaatgatgtcattcttgcggatacacttgcataccctactgtgcacaatgctcttaaagaagccttcccccttcttgtccgagatgatgcccttgacaaattcctcagatagtaactggctgcgggcaggggggcattccgtcgacgcccctgcccgtcaatcacatctttctgatcgcatcgtcatatgccttctgcgcatcatcaagttcggcattcgccttctccaaatttcggtcagcagactcacggttagcagtagcaatagcttccttttgcttggattggcgcaatgcatccgacgcctgctgcgaccttataccagcttgagtcgctttgtttttcgcatcgcgatatatggctccagcattcttcaaattagctatgtattgattgagttgcttttcgtattctgcaactgttaaatcaccgacaccagtattgtaattctggacacgctgactattgtcaccccacccttgcgcattaccgccccacgcaacggcaccaccaaaatcggtcgtatagggatcgacaatattgagatagtgtccaacctcgctgtacaaatcaaaattaggcctttcgctgtttggtgtgggtgggtctgtcaggtggtgacggtgctgaggtccgccacggtcttcgtttcggtggcttctggtcacctgaccctccttgcggtaggttaggtgttgcaacgatcactagaacccgccctctttacttatgaccccatggggcggtaactcgcccatggggcggcaactcgcccatggggcggtttgaagaaattgtgaaaccgcagaataaagccattttcacctaccgccccatgagggttttaccaccccatgggatatttgccgccccatgggttttaccaccacgtaaggcgagcaccgctccatggaacacgcaaatggcccccacccgtgaaggtaggggccattgtgcaaaagggctgagccaagatacagcccagtagccctaaaacacactacaaaatatccggatcgtctttggcaatagtgccggttgccttgccaatggccttcaggccgtggtaggccacaagaatcacgatcgtgccaatggcaatgccgttgaaggaaatgccaccaacagtgaacgcgaattggccgatggcaatgatcatggtgatggctgccaccatgatattcagcggcttgtcgaagttgaccttgttctccacccagatgcggataccgatcatgccgatcatgccgtacagcagcgtggtcacgccgccgagcacgccggcggggatcgtgttgatcacggcaccgaacttcgggcacaggctcaggatcagggcgaaggcggcggcgcaccagtaggcggcggtggagtacaccttggtggcggccatcacgccgatgttctcgccgtaggtggtggtgccggagccgccgccgaagccggcgagcgtggtgcccaggccgtcggccatgagggcggtgccgatctggttgtcgtagtcgcggccggtcatttgggccacggacttgacatggccgacgttctcagccacaagcacgagcacaacagggatgaacatgggaagaatggagaaatcggcctgcggcaggtggaacttcgggaagccgatccatgcggcgtcgccgatggcggagaagtcgacctggccacggatgcaggcatatacatagccgatgatcacgccgatcaaaatattgaggcggcccagcagacccttgaacagcacagccacgagcagcacggccaacagggtaaccagtgcggtgtcgggcgcggcttggaagttggtccacacggaaggtgccagattgaagccgatgatggccacaatcgcgccgttgaccacgggcggcatgatgatgtcgatccatttggagccggcgtaatgcacgagcacgccaaccagggccagcagaataccggtgaccatgatgccgaagctggcgaccgcaatgcccttgttggcggtggtgaccgcggtgatcggtgcaatgaagccgaaggacgagcccaaatagctcggcagcacgttcctgttgatcagcaggaacagtgcggtggacatagccgtgaagaacagggtggtggacgggtcgaagcccgtcagaatcggcaccaggaaggtggcaccgaacatggcgatgacgtgctgtgcgccgataccggcggtgcgcacccaagtcagacgttcatcgggctcgactacctcgccgggcgccagcgtcttgccgtcgccatgcaattgccattggaagatattggacattactactctcctcgctctcgcttggggcacggcattcacaaccagccgcaccacgcaccattctagctcacgaagattttgtgaagtctctcttccgggaaaggctatttgccgtaatactccagcaggtgtgggtcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaagtgcggccggtttccgggtcgcgacgtgtgtagtgcaggcaggtgcagttggtgatcttccagtcgtccgaatcggcgcgatgcaggaattcctcgtcggccagatcctcgatggtgagcatcagggcgagcatgaagtcgccgtgggtgaccatgaccacagattccgaatcggatttgcggctcagcgaggtcaggatgttgtgcacacggtcctcggccacatcggcaatcgactcgcctgccggcggacgccagtacagcggatcggtgttcttgaagttccagttgcgcgcgtagttgtttttgaattcgtccttggtgatggtgttgatctcgccccaagaacgttcacgcagcacacggttctcctcccatttggccttgggcagggccatggtggctgcggtttcgcgggtgcgcacgtatggcgagaccatgtagcggtcgaacagctgctgctggctgaccagccagcgaccgatgcagtcggcctgcttgcgtccggtggcggtgagtctccaggagcggtcgggtacggtgacgttgtcctgcgtgtacagggaattgtcgccctgctcgcccgcctggacgatgacgttcgcttcggattcgccatgccggattacgtatagatcgagcggcatgctcatatatgttcccctttcgttattggttacgttgtgttgttttctgttgtttcctacttgacttgcgtgatggtgttccccttgaccatgaacgcgtgccgggccatgtcgatcatcggctgatcgaatttggagtcggtgtagaactcgtcgatgacggcgtccgggccgtacagttcgcggaaccgtttggccttgttggtgctgaagttgaggtacgtgaccttcatcgtctccacatccacctcgctggccacgagattcctcacgccgagtctgcggcaggcctcccccaccgtcagaccgaaggatgcggtgaggatcacatcgtccgattcaggctggtaccagggcttgatacgtgaatagttcctatcccagaagtcgtccacgagctgttcgacgctcgccacccgtttggatcggctcagttccgcgagatagccttcggtcatcttacccacgccgtattccatttgttcaagcgtggcccggccaagcttgtatttgactgcgtaccgcagcacgggggcaatatagcggaacactttcgggtcgtgtcgggcggaatacaggtacaagtcgaacaggctttcgccatcatagatggttccgtcgaaatcgaatacgcgcataccttctgcttctactctgttattccttgtttaaggctaatctcagtaagccggcgaaagcgcaaatacgcagtgaatttcacatgaacactgttttttggattgatttcggtacaggtaacgtacactggtgacagcgtggaaggaggtgcgtaatggcggcgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgaaatcgcgcgtcgtgaagaccgcgatctggcacgcatcatcaagactttggtcgacgatcccattgagcaacgcattcgcgaacggcgcgcccaagagcaggacggcgaggccgttgccgacaatgccccagtcaatacggacggtggcaacgttgccgacaacgccgccaccgagaaacgcaagcccagtgccgccacattgaaggcttcaaagactgccgcaacgggcaagcctacgctcagcacggcgatgcaggctcttgccgtcatcaccggagcactggccagtggaaccgccgccggcatcatcacttacttgatgttcccggacggcggcccgaacaagcgctgagtcgccgaaatatcgaaacggattggacaacccagttcgaagccctgagcaccattttgtccgtgtcgcaccagcgtttccctcattatcagctgtttcgagttgcatgaatgaaccgtttataggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggtgccggcgcaggtgccggcgcttgaaccggggcggcggtcataggactgatggcttgcgccatattcataccaagcaacatgccaccatcgccaaagccgttgtcttgaataccttgcgcaatgcgctgctgggcagccatattgccagcttgttgggaaacgccctcgtatgcggcaacattcatcttattcgaggcgaactgctgcacgagttgacgtgattgctcggtgaactcgatgctttcgatgcccacgctggacacttcaaagccaaaacgatcattccatgtaccggcattggctcgatcgccacgcacgcatgctgcgatgtcattcgccttgccgggcaattgcgaaatacgatattcattggacaacgaattgatggccacaataaacgactgtacgaattcggacagaatctgcctacgtggcccttcatcatcgaatgaatacgacacggtagtggcaggcacaaagttacgaacgaatcgaactggatcagtgacctttagcgacatggatccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcgacctggttgaagaacgatccgatgccgtctccggcgagcacgctctgttccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgtttttcctcgatatctcatgcatatggccggtcttgcgactatgcaatcgcaagaccggccgttatgctggcatgttggctatagctgcgtttcgcgatcgcagtattcgcatcgaacgacttctttgcgatgaccggaaagcggagcgccacaaccttcgcaattcaccgaaaccacgggttcggtaatcccaagcccactacggaatgcgctaaaagtgtctttcagtgtcccggccagagcctccgttccggggatggccctgttgaaggccggctcatccattggcgtatactgtctgccgcgtatacccatataccgtcatcgtccctttcttggaaaaccgttacctcgatacgccagtctgatcactggcccaccgatgcgagcttctgcgtgcatcgagtcatgacctcggtgtagtaggccaaatcctcactgctgagggagttttcgtcaatggcgtctaccttctgggagaactcagagtaacgcttcatcatgctggcatagtcggtagccatgctgaccacgttatcggatttctgatatttgttcatgaaggcaacatactcatcgataaaggcctcgtagctgtccatcgtggacttgaagtcagcactgtcattggtgttctgctgcgccttctgatccgaagactggtcgctctgcttgttggcatcgctggaatcagtgcccgtatcagtgctcttatcatcctgcttcgcggcgtcgccgtccgtagacgtatcttccttcttctccggaacctggatagtgatggacatgatggtctcgtcgtcagtgtcacgagaaacgctcacactgtatccatcggcgttcttggcattgaaactgtcagcggacttgttatagtccacggtgaaaccgttgtcttgcacggacttgacgtagtcggcatactgcttggcgtcggtaccgcacacctcgatggagaaatagtccgaagactcgctttcaatttcaccctttgtggatttcggctgcggcagcagcgccgcgatatccgactccggccatgaatatgcttcgcacttggtggcgagcgatgcttcccattccgcctgatcagccttggccttcgcaccgtcgcgaattacgaacacgccaccgattaccagacccacaacggtgataccgactgccacccaggccagcactcggccttgcaccttgccactcgggcgagtcacgtatacggcgaagcctgagagcagtgccggaagcaccgtggcgaacagcagtccgccccaggatcggccagaaacatccacaaattgggcgagtacgaacaacactccccagataatggcgaacacagccagcttggaagtcttcttcaccccttgcgcattcggagcaagcacggcaggcgcagcggcaccagcaaaaccagcggcagcaccggcaccgtgtgtggcaggtgcaggagccacaccaatacgcttgtccaaagaggcgaggaactcatcaacgcgcttggcgctttcgtttccagtcgcctccagacgaatggcggtcccagccgcaccctgcgggactacggttagcgtgcagttcaccccatcgtaggagtggaaggaaaacgctccggtctgggtgttttcgttatccaaggtaaacgtggcgccagtagtcagctggtcgtgaataacttggaacagctgttgcggactgaccgcatatacacgatcgaatggcgcgccggcgggctgctgcggtgccgtagccggagtcatcggagtagtggtggccccatcagatgctacgtttggctggccagccggtacagcattcggcacggtaggcgcattgttcgcgcgatcttccggtgcgtcattcgtgccttcggacggtggaaccggctgaggttgttgatcaaatggcgttgtcatgatgcccttctttccttaagcagcagcattaccagcacagaagaggcaatcccggcaaccgttacggtcaatccgactgccatggcaagccggtatcgttcgctcatcattgcgtcccttcttattgctcgcgttgctctgcgatacatcgaaaccagtgtatggcgttgttattatgtacgcaaattagcattttgtattcatgttagctttattgtcgatgcttgataccgcgcatgaacatcctttccgccaccgcacctacacggatggcatcgaccattgtcgacgacacgcgcgggccatgcatcagctgacaactgaatttttcggcgtgtttccgaaaagtcgacgtcctgtacgctgggaatcgagcaaccgcgtacgatggcgcagcacagcacccgcaacacagcgacaaggagcatgggcaatggcagacatccccgaagaacatttgaccgaggaactgttggatcggctgctcgccagcgccagcattgagcagtatctcgatgagggacttgtcagcgcacgcacgctgaccgactatctgttcgaccgtatggaagcccatggcctgaaacgagccgacgtggtgcgggcatccggcctcaacgccacagtggtttatgacattttctccggcaaaagccgccccggccgagatcacgccattatgctggcttttggtctcaagtgcacattacgcgaaacccaacggctgcttcgtcttgcaggcgtttccgaactgtggtgcaaacagcgacgtgacgcgattatcatctggtgtatacgcaatggattcgaccgcattgccacggacgacgagttgtatcgtatgggagaggcgacgttgctgccggccgattgacgacattcggcccaacaacactcaccagtgaaacgcaagtaagagggcatcaaggagagacatggacgataagcaagcgatgcatgcgatgagcatcgacgatgcgtaccatgttgagcgcacgcttgctcgcggaccttccggcgtcactgaactggtgagcattgacggcaacggcccgttcgtacgcaagaagattccctctcccctagcgcaacgcaatgtgtgggcggtgctcagcgcctgccagagtaatcgtctgccgcgcgtggaagcgacatacgagctgcccgaccggttcgtcatcgtctacgattacgtgccgggcagcacgcttgcgcaaattgtggaggaaaacgggcggcttgcgccgaatgtggccgtgcagcttatcgaccaaatttgcgaagccgtgcaggagcttcaccagcacggcgttatccaccgcgacatcacgccggccaatatcatcctggctcgggatggcgcgcatctcatcgatttcggcattgcgcgcatatggtcagcgtcaagcaatcgctcgcgggacaccacggcgcttggcacttatggtttcgcctcgcccgagcaatatggcttcgccaaaaccgacgcgcgttccgacgtgttctcgcttggtcgactgctcggattcatgctgaccggcgcctatcccgatgccagcgactacgagcagcgacttgccgatgatgccgcagtaccggcacgactgcgcgccgccatcggctatgcgtgcgcattcgagcccagcaaacggccacagagcgtccaggagtttcgccaggcgctgttctcccagtccaatccgcccatgccgaacgcatcatcggcaaatccgccatcaccgagcacaacgaacggcgtcacgtcggcgtctcggctatttcggcgtctgcacttgagcaaacgcgccatcgtgctgtggtccatcgtcggagcggcgctggtggtcgccgctattgcgggaggcattgtgttggcaggccaacttggcattatcgggtcggcaacatcgcccgattcctcgacacaatccagcagccaatcaaccgataaggccgatggcgggcactcctcgaacgggtcaggaaccgacaatgccaatggcacgggcggagtaggcggcactgacggcgctgatggaaacggccaagacaccgtcaccgataatcctctgaaaatagtggaatccggctggtcggcggaccagcaagggtatgtccactacgctttcgccctgcgcaacaccagtacgacccagcaggtgcagtatccgcagattaccattacggggcgggccaaagacggttccatcgtgttctcgcagacgcaaacgctgaatatggcattcccgaatcagactgtatatgacgccgaccaagcaggcgagggcacggccccggccaccgtagatttcgttgtgcttagccctgatacgtacaacgtcaccgaggctcaaggaaccgccaccttccccatcagcggaacatccaaaatagacaacagggacggcggcacgacgttcaatggcgaggtccacgccgtggcagacggattcaagccatctgatgggcagcaaatcaagatttccctagtactgcgcaacgcacagaacgcaatcatctatggagatatcgcattcgtggattggccgggcaatggccgatccgcaccattctcgatcaccgtctacgatctgccgaagtattcgtcttacgatctgtatgcgcaaatctggtagttgactttgcgcctgcaaggtggctgtcagcgactgtcaggcttgtgtccgagtcacctgtgcactggtgttgtggcgcgcctggccgaacagatagatgccgatgggcagagtcagcacaccgccgatgatgaacaccagcgaaatcgggatcacgtcggccaacggcgcgaagatcaacatacccagcggcatgctgagtgtgctcatggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagtgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggtgtcaccgagcaccacgttgcgcaggttcgcccggcgccatgtgtagctgaagccatctttcaagtcagcaaacacacgacggacgccggcaatcagcgaacgatcagcattggcatccgacatcggttcgagtgcgggttgcccgctattctccgcttcagccatacgcctcgcaacatgttccgcgctcttcttcggcgctttgatcaacgccacaaagccgacgccgataatggccgtggtcacatcgactaacagaatcgaccacagcggcactgtgttgataagcacagcagccaccgcaggtgccacaatcatattcgccgaattaatcacgccgtatattgagttgacgcgcaatagtttgcccgagggaacaacatccggtatgaacgactgcacagcgggcgtctgcacaccgccgcccgccgaacgaatgaacagcaccacgaaaatcatggtcagactcacccatcccatcgcgaagctcagcgacagcacgacggtgaccacagcaatcaccatatccggcagcataatcagcaacttgcgactgtgacggtcggcccaggagccgccgaaaatcgagacgatcgcctgcggcaccacgccaaacaacgtggccagcagcatacccatgccgctgttcgtctgcagcacgatccaccaccagatggcatattgcacaatattggagcccagcagcgagaacgcctggccgatgagtagaagcactacacggcggatccacgcacgctcggattccccattggccactgctgcggcataggcggcaccgggtttgttcgcgctatggaccgctgcgcgcgcattcacattgtcatcgtcggaaacctcgggtgtttcgcgcacagttggttcagttgttttttgactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgcccttgcgcaggtgccgtaagactccgcggacaaagcgatgaggcttcccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttacgcgtggcgatgtccatcaccttcttgccggaaagcgcctgcaccttggaggccacggtctcgtcgtcgaacaccaccatcgtcgaaccggtgccggtggagaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcccggtgttgatggtgccgagaagaccaagagagatggtcatgagcgcaaggccgccgatacccacgcctcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacaactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacaacgatgaatcgggtgtgcgaatcaataggctttacggaactggtggcggacccgagttccgcggttttctgtgaggtcacagcatttccttctgttggtaacgtcatgtgtggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgagtcttcgtacggcaggcatcgagaagcctatcatcattcaaatcgacggtgaaacccacgcatgctcgacaatacacaaaatcttcacaagaggattgggcttacgcatacgctccgcctgaataacggtccggggatgaatcaggggcgagctaagggttgcgtctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtctgtaacaattgtttctgcagtaggtccggtgcagcgcattatcatcgtgcgttgcaccggacttttttatatacaacaggcatttcacacaccgtgatttgacggattcggacgtaagaccttatggtgtgcacaccatgattcaacacatcgcattcagcagcaacggcgtgaacgaacacgccaagcgtcagcagatgaacctgccggcgatgctcgaatgcgccttcaaacagggtttgcgcactgctcagttccagccaataaccggaaacaagcgcagcctgctcgctgccatacaaatctgatcagtacacctctcattggcgcaaagctgaatcattgccggtgatatcgagccgactcgttcgcaccatgcctcataaacgcacctgcacgagcatgcgttcttggcatagtcgcaactcaatgcaccgcagcaaaacccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcaaggacgcaaggccgccgaggattgggcgaagggcgtggtgcttgacgattcccggctcaatttccgcaaggccgcggacaccgatgcacacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacgatgcacccgcgcgagatctgttcgaatcgattgagccgaacagcacggcggagctgaccggtctcggaattggccgcccgcaggcgacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctggcacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcggatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcgcggacccttacgttcgggttattccggtgcgcggcgaaacagacgtgtatgcgtgcaatttcactgcagaggcatttcgtgaacatcggtggacggatcgcaccatcaatgcgcgagggctttttgtcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcctgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatctgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcatgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaacgacatcgtggaccacgtgcggtgactgctgagttctagcgcaatatcttctgaccaacgtatgtatcacgaaagcatgtgtcgtgaaagcatgtattgcgctagaaccaaatcattctcgttgagggcggataatgaatctctatgctttgaacatgacgcaccatatgccggcatttccttgcgcgaacaactgttcattacgaacattgtactgatgccgttacagaacagaagagggtgctgtcctagcgacaaccatccgacccggttctgccaggcaccgaaccgattcgacaaggacgccgtgaaagacatcatgttcggttgggatgacacgaagaaggatcccaagcgcagggattcccggctgatagtcatcggcgacgaccggcagacgccgttgcagcgcggcgcgctcaccgcgttccgcaactacggtgtgaccgttatcccctactccaaattggaagagcaggctcccgtggaactcgccgcgtagcttccgagccatataaggactcatcccgacgactcaccgcgagcaccgggatgagcccttggttcttgtgtttcgctatatgatcttgtgtttcgctatatgattgagtcatgtcggacgacaatgtccggcacgaagggagacccatcatgaaaaaggcaatcgcactgcttgttgcggcgatgttgcttaccggcctgtccgcttgcgggggaagcactacggccgatgcgccggccaaatccgatggcacgtcaaagaccgagaccaataaggaagaacccaaaccccagccggccgatctgaccggcacatggaagcagaccaattccaacgacccgagctcatacatggaagctaccatcagcggcgacaccatcgaggtcaactggatcggcaccgacaccaaaaacctctactggaagggcacctatcaggcaccggccgcagccggcgattggaaatggaccagccagggcgacaccgagaccatggccagcgcgctcctcgcctcgcaggatgccaccaaggacttcacctacagtgaggcggacggcgtgagctgggagaccaccgcgctcggtaccaccatcaccgtcaagacggtcaagcaataaatcccgtgtcgggcggatcaagccctaaacacgaaaccgccccggtcactctgcgagcgccggggcggccctgcgacatatcgacgattagacaatctgtcgcattttcttgactgccgcccacatgaccgtctatcatcatttatagatcagcgacaagaatacacaggtatccttcccctcgaaggatcagctggtcgtattattggattttggcctgtccttcatcgaaagtcggcttcatgccgtcgtcgtcacagcacgactagagttgagacgggccatctattccttctaccattcaggttgcgcccatccgtcgaagttgatggatgctctggtcagaggattgtatttcggccgataatagttctttgatttgaaatatctgctggaatcataaacatcatggaccagcacaatcttcggttcaagaagcccgaagaacttttcgtctcccttctcgtacactcgctggaccgtccatagactgtagtcggcgagcgccaagagaatttcgtgatcatacggttggacgttgaatttggtggtgtttcgcaattcatgcgttaccgtgccgcgacggctgcgctgttgcgcgatgtccacggcatgctgaaggttgaggttcgatgtgctgctgcctcgttccgcgacgtcgagaatcaacggatctatcttccctgagtatttgagtagatgggacatgaggtcggcgtagaattcacgtggttgttcgttgtgcctctgctgatagatcgccggtatcttacggcccacaactactcgtgcggagaagtcgatctcctgcgccatgagtttgaggaattcatagcgtagttccgcaggatctttgctggcatgcgggtagaagccgtgccatccctcctttattctcttttggacgctgggaaagctctggaagaatttgctgctgttgatctcctcacaaaaaccgtcgatagtcgcacgagcatcgtcgaggggacttttcacatgtacgagcccgatcatgaagcatcgggaaactccgtccatcccgatggaggaggttttgcggccccgcttcccggaatggaaggtcatgtcaccggcctcatcgataaatcgatgatggtcctgtggcccgtctactttctttatgctcatgcggacaagtctactatgcgtcacgttcgtcatttcccctcctcgatgacctgcgcgtctatcacatccctctcgtcgtgcaggtcagggatggctcggtcgaggagcgcggcgagactggccgtgtccctgtgggtgtagtggttggtcatgctgatgctggtgtggcccatgatggcggtccgggcatcgtcgggcatgttggcccgggcggtcatgctggcggtccagtggcgtgcgctgtggatggtgaccggcgggaggccggcggccttcaaggccttgttccagttgtggcgttcggtggagctgcgcacggggttgcctcgtgagttggtgaatatgagttcgcgcgggcctatgtcgagtcgtttgacgcgcgcccacaaccgttgccacaggctcgtggatatgggtacgaaccggtgggcggcgtgggtcttgggcgtggtgagccacaggatgccgtacaggtgctcggctttgagccaggcgggtatcacggcgtcctccggtttgccgtattgctggatctgctgctgcacgttgatgccgggcacgccgtcgcgttgctccagctcatagggcatgagcgcatatcgttcgccctccctcatgccggcggcgaacgcaagctcgaacagcagcatccaggattcatccacgtccacggtcagggccgggccgcggcgtttcgcccctcggttgggcactgcctcgatcagctgtttcggctggtcgggcgagaggatcctcgtctcggtgggctccacccttggcggcctgaccctgcggcatggatccacggggatgagttcttcgagttcggcctggtcgagcatcatcttcaggctcacgaaatggtccttgagcgtggagggcgcgagccgcttggagagcacgcgcatgcattggcgcacatggtcaggtgtcagatccgtgaggcgaacgcagccgatgacctccatgcacgcgtggatcctgccggcgcgtgtccggtatgtggtgggcttgacgttgagccggtactcctccagccaccgttccgcgtaatccttcagatacggcgacttggctccgggcagcagaccggtgcgctccatctccgcgatcctcgcgtcgaaccgttcgcgcgcgcccgccttcgtgcgacccttggccgagacgtagcgacgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcggccattcttcaataatcgaaaaacggcgcgattccacagttccgaagactcgaaaacgttggaatcacgccgttctctagggtgttcacaccctacttcgagacgttgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccagcccttgtggatctgccaggcgcgcacttccttgacgcctgcagtcaggaaggtctgcagtccaaggatgtcgaagccgacgcgggccaactggtcaaggccggattcgcttaagcccgcgtcctcgagcatttcgcgggcatccgcctcgtcgagctcggtcaagtctgcctcgaactgagcgttgaggaacacggccggagccggggccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcggtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaggccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttagcaagttcgtcggccagcggcttgacaacggcggcaatctggtagggcttgatggcgatgatgaccacgtcagcggccgtcaccacttccagcgcattgtgcagcgggcgcacgccaagttcggcggtggtcttctcaagcttgtcgtagtgggcagcacaagcgaccatctggccgccggtgaccacgcccgcgtcaacgaagccctgggcgatggcctgggccatgttgccatatccgataaaaccgatggtgaggttctgagtcatacgttttcctttcgtgcatgtatacagagctccctcatcagagggagcttgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaagtcggatcccaagcactggaagcgttcgacggtgagcgggtcgccgttcggcatcagcgggaagccgtgggcggccatgccggcgatcacgccaagtcgatgctccacatcggtaccagccatcggattcagtaccgaatcggtgagtttgccaatgaattcggcgacttccgcagtagtcggcagcttgtcggcgatggcagccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttctccagatagtcggcttgggctcgtgcgccggccgcggcatcatcgtcgtgcgcggcggcgatgcgggccatgacgtgcgtgtccacgcgcgaggaacggccggtgccgcgctggtcgggcagaatcacgcggaaatgcttggtggcctcttcaatccagccatcggaggtcgggctgttcaaacgcgggccggcaccgccgggaccgccttgcaggaagatcagcagcggcaggtcgtcatgcacatgttcgggcgtggtgaccacgcgatagaacagtttgatggtttccccgtcgaacgcccgcccgggctcgtggccggtccagtcgagcggaacatcgatggaatggtcctctatggccagtccgggcacgtagtatttgctcagcattgtcatggttcaagactctagtccataaatcctcctgaagagtgataccggttcgtcgccggacacgctagccttgtgcgttatggagatgatggcgcgcgtgagggcatggtgcgcacgggagtcgacccgcacactgctatgggacacgttgctcgccgcggcgctgatcgccggttgcgtgccgttcaacggcgtcaccagccctgattcgacgggcggcatattgtttcccgcaactcaggcatcgatgacgctgtggtcgctgccggtcttcgtgccgctgatgctgcgcaggtatcgcccggagccggcggcctggctgttcgtggcgctgaccatcacgcatcttgtgctcggcccggcgatcacgtatttcgatttctacgccctgatcatggtgtattcggtgattctgtacggcagtccccgacattcctggcggttcattgtcacggcgttcgtcatgggactggtcgcggcgacggtctggtcggtgtctttcaacgtgggtccgctgttcgccggaccttcctccggttcgcgcaccatccgcgacggctggctggccgatgccatcacgatgcccacatgcccggcggtcaccggcgtcgtgggggcaagcggcgccgtcaactgcggagccaagatgctcgctgacgtcggcatggaggcggcgctcatcgaatcgagcgtgctgagcgtcatcatcatggccttgtggcagcgagcgcgcaaggccacgctggcggccatgcgcgagcgcaacgcctccattgtggcgaaagaggccgaggagacgcgcatcgcggcgctggccgaacgcgcacgcatcgcccgtgatatgcatgatgtggtggcacatacactctccacgattattgtgcagtcggatggcggccggtatgcgggcgcgcatgatctggccgtcgccaagcatacgatgagcacgattcgccatgaagcggaacgcgcgcagcgtgatatgcagcgtctgttcaatgtgttcggtgcgagcggcagtaccggatatgccgacatcgattcgctgtttgatggccatctggtggtttcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggtggcagcgtgcaggccggcccagggccgaatggtggctttattgtggcggctacgattccgctctcccctgccgccccacagtctggcaccgatacggaggatccggtgctaaccattatctcgcgtatacgaggattgatggatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactataacgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtactgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggttatgctgtttggctttgcctgcattgcgatggcccggtggagccgttcacgcggttcgaacgcgctggtgctcatgcaacgcgaggaagcgctcaaggccgagcaggagcggcagaaggtgctggccgccaatctggagcgcaatcgcatcggcacggccatgcaggccgaggtattgaatacgttggaatcggtgatcacgcaagccgatgatgggctggccatgctcaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcgcccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcatcccctcccctgccggagccgcttccgacggttccaatacgtcacgcccggcatacaccgatcccgaactggatctgcttaccgaccgtgaacgcgaggtgctggtggagatcgcccatggtctgagcaaccaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtggcccattcgaacgggaacacggtgtcgccgtacaaactaaacaccatgtaggatccgagccagccgaacagggtacccaataccactcccaccacgccggagacgagcgaaagcagcaacgcttccaccgccagcgagcgccgcagttggccacgcgtcatgccgatggcacgcaaggtggcggattcgcgtgtgcgttcgatcaccgacagactcagcgtgttcgccacaccgaccaaggcgatgagtacagccaccgcaatcaaaccgaccaacaatgccatcatgccgttgatcatggtctcccattgcgtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgattccaccgttggtgaagtggctggcgtccacgaaggcgaccgcggcgtagttggaggcgatgcggcgatagtccaccttccgcggtttgagcgtcagcgtctgtgtgccgccggattgtccattgccgttttcggcgctgccgttcgcatcattaccggacggaccattggcggcatcggcttgtgcttcggccgctccagccgtgaacgtgacgctcttgtccagcggaatatccttgcctgtagcggcggaatacttgggcatcagtacggaatcgccatcaatggtcacgccggacaaatcggagcgcaccaccttgcgcagcgcgtcgacgccatccacgcccacgaccagcacactcaggctcttgccgtcggcatccttcatggtcatcatgcgggtcggcgcgtagacactgctctgaacgcccttgactttggctgcctcgctggcctgtttgccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccagcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcatggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgcgccacaagcacttggaaggtgttggcgatgacgagtgccgcgaccagcatggcaagtatgccgaagctcagcaggaagatggtggtgatgctggtttcgcccgaactcatgcttttgacggattcctcgacgagcgcggcacgggattgcacgctgaaatgcttagggagcagtgtgctgacctgttttacggtggacgccgcagccgtgtcactggcatcgtcgatgtcgagatagacgaggtagacaggcaggttgccgaaatcgttgctgccggccatcgcggtaataacgttgtcggaaagcacggaagcgccaccgtagtaggcgtaggcaccgttcgggtcgtcggtgaggcctaccacgcgcacggtcatgccggagtcgacggctatgtcgacaccgtcggatgaggcggacgcacctgacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgcgcgtccttgacgcctgcggtggcgcggatgcggtcaagctggaagtcgttaaccgtgcgcgtgtagatgtagtcctggtccttatcggtcaggtccttgccgccatccgggctgatcacgtagttcgcgccgccgagctgggcagtgttctgggcggcaagcgcatcgttcatcgcgttgccgaacaggaaggtagcggcgatgaacgcagtgccgatcaggatggcgatgcctgccggaatcagcatcctggcgcttttcttcataagtttcagagtgatggaaaacatgggggtgtcctgtctctcgctttccgtctcagcgagcgtgctgtgcggcggcgcgggcatgatgcatggtgccggttctcccagctgggggcaatggagcgtcggtgatgggcaggttgggcacatcctttacgccggcaagacgggcgagcgtgtcggcgcgtgtgctggtgacggcagcgcgcgtggcacgttcgcgttcggccataagcagatcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccgagcacttcggcgctggaaacggagtcgaggttgccagtcggctcgtcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgttcatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagtgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtagtcgatgaccttcagcgcgttctcaacgtggcgttcgacgcgcagcgacagggtttcggtgccctgcagcagcaggaatgcggcgaacggagacagggtggcaccggtgtcgcgcagcaggatggcgcggatgcgggtcacgaacgcggatccgcccagggcctcgtagaagttcaatccgtgataggacggatccggctcggtcagggtcgggaacttgcccggcacttcggcccagttgaagttgccgccttccacaatcacaccgccgagggtggtgccgtggccgccgatgaacttggttgcggattcgaccacgacatcagcaccgtgctccagcgggcggaacaggtacggggtggcgaaggtgttgtcgacgatcaccggcagatgatgcttgtgggcgatggcggtgatggcttcgaagtccggcaggtcggcgttcggattgccgaaggtctcgaagtagacgagcttggtgttctcctggatggcgtcctcgaactcctgcggattttcggcggagacgaaggtggtggtgatgccgtcacgcggcagggtgtgacgcagcaggttgaaggtgccaccgtagatgttcttggcggcgacgatgtgatcgccggactgggtgatgttgcgcaccgcgtattccacggcggctgcaccggaggcgacggcaaggcctgcggtaccaccttcaagagcggcgatacggtcttcgaacacgccctgggtagagttggtcagacggccgtagatgttgcccgggtcggcaaggccgaatcgggcctcagcgtgatcgaagttgtggaagacgtaggaggtggtctggtagatcggcacggcgcgggaatcggtggccgggtcggcctgctcctggcccacatgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcacggcgcaagctgaacgttatcggacttgcctataagggcttataaagccttgggatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcattttctgccgcccggttacatggtttacatgacgaacgactacagtcaaacatcgccaatgaattattccgccaacatggtgaagggattcgaacagacatgaccgatgtaacactgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacgcgctatgcagtgttcacgttccatgacaccacggatattctctccggttacttggatgcctggcagaaggaagacgtggagctggatggcgtgtattcaggcttcctcggctcccccgatcaggtggcaattattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtattgatgccgaacctcaccgaagcaagcattctcaccaagcgtgactatcctggccaggatattgatgaggccacggttaacgagctgcttggtgctctgctggagttgggtgccaagaacgtggtgctgaagggcatcgaccatggcgatggcaaaatcgtcaactatgtggccagcgcttccactggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgccacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgtttttcgtcacagggaagtcgactggtgagccttggtaaaccttctgaactaatggtggataaccgggttttcatccacacgtcatccacaacacgccaaaccgcgtcatagtatccacatttgccggttgcgcttgtgctcttacataagtaacccgcacagtggaatcatgaacgctttaccacctacccagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgtgtgccgcattcggcggtccgtttcgatgtcgtcaccatcgtgcttcgggtgggcaggccgctcgtgcatcacattgaaaatgccttctgaagccccccaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcggcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtgggtggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcgctgcaagtggcggcggcaggcgggcataatctcatcatgaccggcccgccaggcagcggcaaaaccatgctggcctcacgtatgcccggcatcatgtgtccgttgaacgaggcggaacaactggaagtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacgcgcgcgcatcgaggcattctgtttctggacgaggcaccggaattcagcgcacgcgccctgcagacgctgcgcgaaccattggaatccgggtatgtggcgctttcccgttcaaaaggcagcacctattacccggcctcattccaactcatcatggcggccaacccctgtccgtgcggatactattacggcaccggcgaacgttgcgcttgccgggaaaaagaccgtatacgttatttctcgcgattgtccggaccgatattggatcgtgtggatattcagatggcggtgccaccagtctcgcgcattgccgtgcaaagcgagccaatcggcgagtccagtgccgggatacaagctcgtgtgattcgtgcccgtcaagtggccaaggaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccaccgagcaggacgtccatcagggcatcgaaatgagaacgaggatgacatgagtaacgctactgatatccggcaatctggcggcaccgcaggcagtgtggatcacaccgatacgagtctcgctgtttcgcgcaccattcccgtacctcctacggatacgttgtatcgtgccgcgctcacgttctgtcttgatggcgcggatgtgatgatgtacgccgcgctcaaaggcgcggaaaacgccgaatccctctggcatgcgttggcgcaatcccacccaagccagccatctgaaatctgtggcccggcgctgtcacgtattgaccgcatgttcgtggacggcctcactcgatggggccgcaaggcgtcggcgaacgcgatgcgctccttccgcaatgcactggccggctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcagaaccgttgccgtattcgccggcgggctcaaccatatcggaccgatgcgtaaccgcacgctgttcgaacgtatcgaggcgcaaggcggtgcactgatcagcgaactgtgccccgggacgattcccgaagcccgtcgttttctgcttcgcaaccgcattatcgcggccatgtcttccacattgatcgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttggcacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgtctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgccgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcgctggataacaagggcctgctgactgcggtcgattccaccgctcagggcatcgcgctgattcgcaaggcgttcgccgagctgcaggacgagaccgacaccacgttgcgtgcggtgaacgctccggccagcgtgtttctgccgcgcctcaacgccaatgattacgatctgatcgtggtggcgggcgacgccgagaactatgccgccacgttcgcccaggcctcccgtctgctgcgcacgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctctccgaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctggaccaaggtcagcagctcgaacatctcatccagtgtgccgaagccgcccgggcatacgatcacgccggaggaatacttgatgaacatggttttccgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcggatttcagcaggttggcggtggtgttgtccgagggaatcatctggccgcgtagaatcaccgggccgcgatgataggtgtcgcccagcggcgaggcgtcctccagatcgaccgggttcaccggtgtggccacagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgcacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccaagctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactgcgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaaaccgcgtgcgccggtcccctgcttgatagcgatatcagcagtcgcccgaatggcctgttctgtgaattgcagatcgacgccgtcgacggcgaacagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgtgtgtccatctgcgcaacgtcctgctccttatgcttgcgcgtgccttccaacggcacggaggcgatggttccttccaagatcttcagcaacgcctgctgaacgccctcaccggacacgtcacgggtgatggaggtgttctcaccggatttgcgggcgatcttatcgatttcgtcaatgtagatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggtagcacgcgtctgggtgggaacggattgcttggcttgtttgccggtctgtccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactacgccgcaccgtcgaaccgccacgctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcgcgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtgccggagctcagcaggaactggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcgtcttttcgcgtgctttttggcgggtagcgtagggatttcgggttattccaaggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcctctcagagaggggagccagaatatatgtatttacttacttacgactcagcaaccactttgatatcaacgacgacgtggccacggccatgccgaccggtacaaagaaggtaatcggcgcttcagagagctccatcaccaagcacatggccataagcggtgcctgctgtgaggccgaaagcaacgaagccgcaccgatcaaggcacacacagttaccgaatcagtcggaaacatcagtatccatacgagaccgagcatcgcacccagcgtggaacctaatgcgatgccgggctgcagcacaccgcccgacgcaccggagcgaatggtcatcagcgtcaccagcgctttggcaacaaaggtaagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacaatcgccaccaaaccggtgatgagaccagccagcgtcatctgccacagaatagccttaccggttggcttgtgcgcttccgcccattgcgaaccttttcggaacaatgcgccgcccactccacatgccgcaccgcagatcagagcgaacagcattaacgttggcgtggattccggttgcatggcggtaatgtcgtagaacaggcaatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccggcaccggcagccactgccaccaccatgcgccggtcgatgccgtcaacgccctcgatatggaacaggtcgcagaaacgttgcgcgagcatggcaccgagttcgcgtggggcgacttctcggccgatcgaggcaccggagccgacgatgaaaatctgcaataccacatgcgcaatggtttgccagaaaggcattcgctttcccgccacggccttcttgactgagggcaccgcagtcgttttgtgtcgcagcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgccacgctcgacagctcccctcaaagaggggagccaaagaaatagtccttttgccagaataggaagagcccggaaccatgaaacacgattccgggctcaaacaatcacgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgatgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccggatccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggtctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggtgggcttcagggctatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgatgaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccatcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttggaatcccagtcaatgcgcagctcatgagcataaagcatcatgatccagcctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggtcacccgttcgcgggtggcggcgttgggtcccttctggttctccagcgggtatgggatgcgcagttcgtgccacttcgggcggccaagctggtggaatcccagcacgtcgatgtgttcgacggcatcaccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtaattcgtgttgaggaagccggacgtatcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcagcgggcagccggacatgaacacggtcatgcgggtgcccggtccatccacggaggtgttgatgtcccaagagtggacgaagccgatatcaccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtagaccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccattcgagggccttctcgtagttgttcttgaccttctcgtaatcgagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgcccacgcgcatcggggagacgcagcatgcgatggcagcgtcgtcgccccagtggctacgaatttccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagagccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtggcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttctgtgaacgctaccattccaatggcttctagatattgatgggactattgcacgtctccagatatgggaaaccgctcatactgtgatgttcgtatgagcggttcggtcttgagattgacagcagaaccgtatccgtcagttttcgaccgtcaatcctcggggcgagcctgtgcgggtttcacgccgtagttcttccagcgccggttctcctcctcccatctggcattgcggtccaccacgatgtcccacgcatgttcggcgtcttccttggtcttgtacggacccatgcgctgttcgatcggtgagaccatgcccaactcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcgcggccgaacgcgagggccgtgaccttcggtcccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggaggccaaatcggcggcgtcgtctttggaaccgtcggaggagtacatggagggcatggagatgccccagacgttctcgccgccgcatgcgtcggccgccatggcggctaccagtgcggagtcgatgcctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaagctgccgccgtcgaagacgaggtcgtcttgaccgccgacctgattcaggtagatgaccggggcgttaacctcggcggcacgacgctgggcgagctcgaaacgggtgttggtcttgccttcctcatacggcgagccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccagcccagaccacgccttggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagattcttagtgtagccgcgtatgacgtcggattgcctgttcttccggcttggcgtcattcattaggtcgtttttgcgttcattaggtcactgcaatgcgatatcagtcgttgcaatggcgcgattccaacaaccagtatcgccgttcaccgacctaatggacgatgaatcgacctaatgaacgaatgccactcccctcagtcagcttcgctgatagctcgtcctgcacttatggacgggcgaggcccgcgcatatctggttcggctgtcgcctcaccttcggctacagacagcccactgggctgtctgcctaacgcctcagcctccggaggcgagccagaaaaggatttacttcagctcgttgagcacgcgcagagcggtgttgacgtagaagttgacgaaggtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttggggttgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatagtgatgagttcgtggtcgatgtcgatatgttcactcatggttcccgattctagtagcgcgaagaatatattgcggccctcgctccatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccaatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgcgaggtggcgaaggtgcacatcaccaccatcgggaagatggcggccacggtgccgatggacgtgccgaccacgacgatggtgagcggctgcatggctgccaggaagatgatgaacggaatcgggcgcacgatgttgacgatgatgtcaaggatgcggtagacgaccgcgttctcgaacaggttgccggggcgggtgccatagagcaccacgccgaggatcaggccgaggaatccgccgatgacgagggtgacgagcaccatggtcagggtctggccaatggattcgaacagtagtggacgcagcacgttccagtcgctacgcgggttggcgaggatgatcatgcgttggctccttcatgtgcggcggcggacgcggcgggcgcggtggcagtatcggccgccagtgggtcatgggcgcggtcttcggcgtaggaggcatgtccggcgactgcgtcggcgtaggccacaggctttgcggcggtgccgaagtcgatgacgtcgctattggcggcgagctcgcgcaggaattcgtccacatgccagccgggcccgttgaattcgtaggtgatggcaccgatggcggtccccttgaccgtgtcgatgccgccgtagagcaggctggattcgacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcaatgaatcgcttggtcaccggctgctggggtgcagcgaacacatcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtaccaagcacggtcacagtgccggaggtgggtcgttcgagcgcgttgataagccggaccagtgtggatttgcctgcaccggaatagccgatgatgccgaagatgtcaccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggacaggctagtcgtgcgctcgtatcagccgcggctcactgctgggccttggcatccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcatcggccacgtagtcgttgttgatcacaccagcggcgatggtcgggtccttcagggtggtggccacctgttcggccttgagcggggtgaccttgaccttgctcttggcttcgtcgatgtaggccggggtggagaaggcggtccagtcgcccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgtcctgcttgaacttgacccattcggggttggtagcgccgaccacgccgatcttgaccgggttgcccttgctgcccttggcggacgactcgttggcaccggcaaacgcgcggtagccgaagaacgcggctacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccatataggtgtcttttatggcgcgcatgcaatgtccgggattcgtgcgtttgataacccgctataggcgtgccgaacacgccggaaagcacgtcgagaggggctttgacaatggaagctatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagactttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggggtcgcgatgggcaatgcgaccgccgagcccaaggccgccgccgactacatcactgacgatgtggaccacgacggtgtgcgcaatgccctgctgcatttcagggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtggtacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttaccagcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccggatcctggtgggagaagccgttgtggtcctgacgccaaacatgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgggaacgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacaaacaggctcgggttgtccatgatggcgccgtaagcgtgggacagagcgtaacccagctcaccaccctcgtggatggagcccggggtctccggagcgaagtgggacggaatgccgcccgggtaagagaactgacggaagaacttctgcagaccagcttcgtccttggtgatcttcgggaaggtctcggtgtaggtgccgtccagataggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcgaaattgttgcggatatttcagtatttgtgcggttcgactgaccgtttgtcaacattagttttttcaacatactttttcaaaacggcggaagcatgcggaaatccagcatttggctagaacagcgcacgttcgatttcccatgttcgaaatcggcgtgttgtccgtctacaggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggctttttctttgccgttttactccctttcacctgcgatttcgccatttactccccgtgtttcaagacaacaaggcacggggaggtattcgagggaatgggagtaaggatttatcccaagtgagttgacgcgcggtttttgtccccgagggcgaaacggggccgtttcggggcccgtgaaactcaaatcgaactcaacgggcattttttgctgggcgttccaatgttcccgttccgtgggataccctgattctctctgtggtactgtttgtggtgtttcctctggctggcggtatgctgacccgttcggctgtcatcaagcggaaggggcagtgtactttgaggagactttcatccatatgtttgacagtgtaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgccctacaagattgctgctcccgccggaatgatttgtgcttccaacttctttgaactggctgttgctgttgcaatcgccttgtttggaacgacttcccctgcggcactggcaacgactgtgggtgtgctgacagaagttcccgtgatgctgttccttgtaaaaaaacgcaaataaaacgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgggctgtcctttcattggtagagcatttgacgataactggggattagaagatccgaccggaagcgaagatcaagtctttgtcgagatcattcgagagattgaaaaacggattctacagttgaagcagtcccttatttcccgggttctaaatagaagtgcaacaccttgtctagggttggaagtgttcgaagtttctaacttaagaaggtgttgcactcatgggtcaacagtattcgcacctgtcccgacagggtgtgggagagtagcacgccgccgcaccacacgtacaggaagccccttggagcacacgccccaaggggctttcgcatacccgaaaccaacaagacaagacaccgacaagacataggctctcgcacctagggtgtggccgaatcgaaagcatatagaagagggaaccctccaatgacggagagttccctctttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggcagcacgatgataccgcgctggatgtgccaacgaatcactacctgtgcagcagacttgccgtacttggcaccgatttcggccagtactgggttgctgagtaggttaccgccggtgccgccgagcggactccacgcctcggttgcgatgcccttggcacgaagctggccaataagctcttgattggtgaattgtggggaagactcaacctggtctacagcaggcaccacatcgctatgggtcagtagctcatcgatatgatgcttttggaagttgctgacgccaatggccttggcacggccagaggcataaatctcctgcaagtcgtcccatgcctgctgccagccgtctgctggccagtgaatcagatacagatccacataatccacgcccaagcggtcgaggctttcttggaatgcatccttgccgcggcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggtgacgtgcataaatgggttaccggcgtattctccgatggcgattacgcagaggcgcatcagcttatcgaaacatccaaacccggctccaacggtgtgctatgcctgccatatctggtgggggagcgattccctgttatgaatccgaatattcgcggtgcctatgtgggcctcgatccagacaccgccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgtgttggagcatcccatcgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaacggactggtgcaaggcgtgggattccgttattttacggtgactcaggcacgtcggcttggtgtacggggttgggtgcgtaattgtcgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggccccgcacgttggtacgatggggcgttatgagtgagaacatgatgcaaatcattgacctgcgtggtcagaacctgtcccgtgccgaactgctcgccgcgatgccgcgtgctgcaatgggcacttccgaagccaccgatctggtgcgtccgattctggacgatgtcaaggaacgcggtgccgcggccctgcgcgacttcgaggagaagttcgatcacgtgcgcccgaaaaacctgcgcgtgccggtcgaggcgatcaaggacgccctgaccacgctcgactccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgttggccatcgccaccccgcccgcccgcgacaatgaggaaggcctgccgaacaagaccatcctcgccacctgcgccatcctcggtgttgacgaggtatacgcggtcggcggcgcccaggccatcgccatgttcgcatacggcgccaagggcagcgagccgcaggacggcgacatcctgtgcgatccggttgacaagatcaccggcccgggcaacatcttcgtggccaccgccaagtcactggtctccgcattcgtgggcattgacgcggtcgccggccccactgaaatcggcatcatcgccgatgaaaccgccaacccgagcctgttggccgccgacctcatcggccaggccgagcatgatgagctcgccggttccgtgctgttcaccgactccaccgagattgccgacaaggtgcaggagaacctcaagtaccgcgtgccgcgtaccgagcacgccgagcgcgtccacacgtcgctgtccggcacccagtctgccatcgtgctgaccgacggtcttgaccagtccatcgacgcggccaacgcctacgccgccgaacaccttgagattcagaccaaggatgccgatgctgtcgtcaagcgcatcaagaacgccggtgccatcttccgcggcccgtactccccggtgccgctgggcgactacatgtccggttccaaccacgtgctgcccaccggcggcaccgcccgcttcgccgcaggcctcggcgtgcacacgttcatgaagccggtcgaagtcatcgaatacgacgaggaaggcctcaaggctctcgccgcccgcatcaacgccttcgcggtgtccgaggacctgcccgcccacggcgagtgcgtgctctcccgcttcgtcaaggatccgtatgacaaggccaccctgcgcgagcaggagaggggagccggtctgcgatgagctcgattcccgaaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacattgaattgcgtcaggcattctccgattacctggcccgtgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcactccgttgccgatggaggatatcgaacgtattctcgccgcctgcgaaaccgctgaagtggtcggcgcgggcgagggcgtgcacccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcggcgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccaccgaatcacacatcgacctcgaactgaacctcgacggcaccggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgctttgccgacgccaccgtgccgctcgacgaggcgctggccaaggccgtggtcgacatttccggccgcccgtactgcgtgtgcagcggcgagcccgaaggctacgaattctgcatgatcggcggccacttcaccggctcgctggtccgccacgtcatggaatccatcgccttccacgccggcatctgcctgcacatgcaggtgctcgccggccgcgacccgcaccacatcgccgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaattcgcggacgattcggtatccggcgatgccagtgataccagtgatgccgataaaacagcggacgctgcttcagcgaagtccgattccgacgcgaatgatgatacggctgataaggcttccgctgattccggccagcctatgaccgacgacgtcaccgggtccgttgcggatgcggtgaacgaggccatggccgacgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggtccggaagccgcagccaaggacctgaccaccgtggtatccggcatggccgtgattcttgcagtcaatcgtgccgacaagctcgaagtggccatgtacgtgcagggagaggccggacagagtttcgcgccgcccgtgctgttcacctccacgccgcgcttcgtcgaggacctgatgctcggcatcgtaaccctgaaccaactcaagacccaagggttcgaagtggtggattccgctggactcgaccatgaccaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacgcttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacccctcctacggacagcccattgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtgggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcgcgcagcacacggctgcgtttggaaccggtggtctcgaagcggtcgagcgtctcctccacgtccaggtgctcgtaccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgactggcgtggaagccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccagatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgtgcgctcgacccggtggccaacccataccttgcttactcggtgctgctggccgccggtctcgatggcatcgataagcagatgcagctgggcgaacccaccagtgatgacgtgtgggagctcaccgacggcgaacgtcaggctatgggtattcagccgctgccgcgctcgctggacgaggcgctgaagatcatggagaaatccgatttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccaaaccccgtcgatgattggtcatcggcggggttttctatggcgtgtcgtggtggtgggtagtgggcagaggtgggaataacgttgtcgctgagttgatacgaaaaaacgattgacataaccgacgaatcagcttgtagtacgagcgagagcactcaagagagcacccatgacgaacgcacctgcgaacaccgcgcgtaccggcctgcacttgggtggccgatacctttggttggcgtgtcacctttgccttggtctcggtgctcaccgccgtgctgatggcatcgatggcagtgtctctgccacgcaactcgcatccggcgaagatcggtttcctgaggcaattccgcctgttcttcgaccgccgcatccagctcggcgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggctttcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgtcgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcgaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagcacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaaccgcagcgcatccaatgcgccacgccagagcatcgtggcccgggactcggtggtggcacccgccttatgtaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgaccctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccaggctcaccgaatcgctggataccagacgctccaccttggccgggtcgaaatcaagcagattcggctggcggtcatgctcggacttccaccatttcgccagatcggccacgctggtcacatcgttgggaatgaccgcgttgtagaaatcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgcaccggtcagccccgcgaaatcggaggccttgggctcgcgcaccacctgcatgcccatcatcgacagcaatccggcgagcatcgacttgtggatgccgtccgcatcccacgcgcagcacagcgaatgcgcggcctgctgattcaacggcagctggcggatctccaagcctgggcgggaggcgggcagcgggtcgccgaccttgaacttcagctccttgcacatctggcgtagctgggagacgagatctttccactggcgcatcctcagccagctgaaatactcggttttgcagatacggcgcagcgcgttgttgctcgggtcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttgggaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtgaaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcctacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagatgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatacagcttgaagcggacgttgatgcccatcttgccgctcaggtggtcgaacagtccattgactaacgtgataaacatcacagtatattcgtgagcgctaacaaccgttgaaaacattaccatacggttgtcaaacagggtggtgtgccggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgcctgcgcttcctgattgcccagcagaccggcgtcaacgtcaagaacgtgcacgcctacatcgccggcgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcattctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcacaagactcgacctacctttgtaggccttcaccttgtgcggcacgaaaatcgcacacgtacagcgattttttataccctgctgaatgctcccgttgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcaactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggagatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccacgaacagcagcaagccgatatcgtcgatttccgctttggaaccgccgaacagacgcatgccggcctccatcaacgcatagatgccaacgacgagcagcaccacggcacctgcggcagcagtgagcacctcaagcctggcccagccccaagtacgagtgttgctgggcttgcggcgcatcagtatggcggtgattgtggatgccgccagcacggacatgtcggtgagcatatgaccggcatccaccagcagggccaatgagccggttaagacagccgacaccacttcgatgaggaagaccgaaccggttacggtcaacgtggcaatcagcctacgctggtgcgcggcagggtttacggatgtggatggtgcgggtgcatgggtatgagccatatgtactccttcgctctatcgagttgaaaccgcttctcatttccatttgcgatatggtctgaatacgacgaaaccccggcgcgaggccggggtttcgtaagctgtgcgtgactatagcacgaccagcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcgtccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacgccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggggcgaagccttgttcgtcgatatgcgtgcgaatggcgtccaacactttgcgctggcggtcggtcagggtggactcgtccggcttctgcttgggggagaagggaatggtgctcacgtcagggctcctttcgttacgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggaacgttccaccggaatgtgcgtgggaagattatcgcagtgatggtcgccttggcgctggcctggtgtggtttcggcgcgcttaccgctcagcgggcccaatcggatacgggggccacgcaggtgaccagttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaagagacccgtcatgatgacgggtctctttcatatcaatcgaggatgagctgcgtcagctgatgacacgcatgcgaatggtgccttcgatgttgcgcagtgcttcaagcgtggcggcgctgggcgtctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgtggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaagccggtgttcgacttgcggccatccacgtgcagggtcacggcatcggactgttccagcagttcgttgagggtgtcgcaacggtgggcattgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtgacgttggtcttggagcgtacgcccaccaagtccacgccatccagcgcatcgatgagttcgtcctcgctcagggctcccttcatggtctcgacttcgaaaccgtgatcacgcagcgatttggccgcatcggggtgaatgttttccaataacagtgctttgggcatgcttcataccttagatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatggcggtcaattcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggagggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcgagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtaatgacggtcgccgttcttggcatcgaggcggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaacccggaataggtgaattcagcgtgaattcaccatgctgctcggtcggtggggtgcgcgacgtggattgaatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgctgatgccaacgcacaaggctccaccactatggccgatctcatggctggtctgccgccattgcttctcggaacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggagccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggataacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccattgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaaacgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccggctgctggccaaagtcctggatatgaacgccatggaactgggcgctgatctgtccggtaccgggcagtatgtgattctgaagaaagatgtgactccgcaggtcaagcgcagcatcgaggcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattctcgcactggccgatagcgatgaagtacaggctggtaccgatgcggcgaagatgagcccgtctcgggccgtgtccgaaaccttcgagcctggttcggtgggcaaggtcatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccctcggcatgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagagcaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggtacgctctcgtccattatctccgattattccgtggtgattcccgcggacaacccgcgctatgcggtcaccgtggtgatgaaggatccgaatggtgtgttcggcgggctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcatgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgagatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcctggaactcaaatgacggcaaggagccgttccgcgtggcgctgctgggtgccatgctggaactcggcgccgatgaaacggcattgcacacctcgatcggcacgtatgcggacgaattgggcatcgacgcgatcatcgcggtcggttccgcccaagaccaacatctcgatgcactggcacaggctctggcggacggtgcccgtcagagccaatccgcgtcggtggattgcgtacacgacatcgatgcggccgaacagctggtcatcgacttggctcgcaaccatcccgacgctgtggtactgctcaagggatcgcacgcgtcaggcctgagcgctttggctgaacgctgggcaaagaactgaccttataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgctgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatttgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctggcggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggcacccacgtgattggcgtcgacgagaggaagcccgaggccgatctccactcctttgatgacgtggactgggaccacgtggactacgtcatgttgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatccgcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtgggattcacgctcgaggcccctcaagccggccagatcggcattgaagatggctggatcgtggacaggagcggcgtggccggcggcgcagtaggagagtcggtcagactggccgccatcaccgatttcacgcatctggcagagccggacggctcactgtacccgcatctggtggccgatgcattgacggcattggcgttggtgctgggacttggcgctgatcgcgataccgcgttgaaggcgcttacctcgttcaagccgggcggccatcgcatcgaaaccgtggctgaggccgcagtcgagggcggctctgttcgttttgtggacgattccaaagccaccaacggccatgcggcacgcgcctcgctgtccagcttcccggccaagtctgtgatctggattgccggaggtctggccaagggcagtcgattcgaggacctggtcaaggaccaggcacacaccatcaaagcggccgtcatcatcggcaaagaccagcagccgatgatcgaagcgtttgccagccaagctccggacatcccggtgaccatcatcgatcccgaagacaacgataccgtcatggaccgtgccgtcgaagcctgcggcacgtatgccgccgccggcgacatcgtgcttatggctccggcctgcgcctccatggaccagttcaagtcctatgcggatcgaggcaatcgattcgccgccgcagccaagacgtggagcgaggtgcatggcctccactgatacccataagcgtaaggcatacagagcccctgacaagccctcactcgaaatcgccgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgttctttgtggtgggtgcctgcctgttgcaggcgctgacctttactcctttgggtcacgacgtctacggcaacagaggttggctggacctcggcttcaccactatccagccggccgaattcatgaagttcgcgatgtgcatatggctgccctcgtcgttgcatgcctgcagcaagatgtaccacaagaagggaatcaaagcatatgccgcgccgttggtgttgtatgcgataggcgtggcgctggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaactacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcgccatttggatcgtgggccaggccatggtcaacatcggcgtggtcgtgggtgtgttcccggtattgggcgtgcctatgccgttcgtctccgcaggtggctcatccatgattatgtgcttgacggcggccggactggttgtgggacttatgcgctctcaaccgcagataaaacagtcgcgtcagagtgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcttgtgcccgatctgctcgccgatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgtattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggcaccacgctggacggcggacacgcgggcaaaggcgatatcctggtggccgaagccgatgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgatcccgacggacttgccgtgctggaggccatgcccgccgacgtgaaatcccataccgttgcctacggcactaccgcgcgtgaatccctgcccgatttgggcggtgccgcgtatgtctggatcgcttcggaaagcgagaccgcaggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaatgcggccggcacattcctcggtgcggcacgccgcttccaggtgcgcggcacggtcaagcaggtcactgtagtggacgattacgcccaccatcccaccgaaatcgcggccctgctggatgcggcccgacgccggtaccccgattcgaccattcgtgtgatcttccagccacacctgttctcccgcaccaagttcttcgcgcaccagttcgccaaatccttggccaaagccgatgacgtcattatcaccggtatcttcccggcccgtgaaaagcaggccgatttcccggacatcagcccctccaccatcgtggacgcggctgcgggactcaaggatgcttccgcaggcacgtggattcagccggtcgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtctgggagctcccgcaagccgcgcaccatcggttcacgcggaaacacgggtcgctcgtcgaagtctcgcgctccccggtccgtgtcttccgggcatgagatcgacaagccggagatcatcgacgatgtgacggtagccaagggccaggccggtgccttcgtcgatgcacggcggttgcacagcgaggattacgttgccgaaacgctgcatcagaccaccggctccctaggagtcgcatcacgcccgaaagtggtgaatttcaccgaacgcgccaaagaacgcaagcgtgcaaacgtgcgcgtcgttgcgttacgcgtgttgattgcggtcgtcagtgtggctgtagtggcggggctggcatggctgctgcttttctcgtcggtgtttcgtctggaaaccagcgagatcggcgtatccggtgccaacgaatgggtgagtgcgcagaccatccatgtcatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgaccaccacgcttaacgacggtgaccgcgtaatcatttggggcgactcttcgcaactgaagctgaagttggcggaagtcgaggaaatcgacaagaacatcaccgctggcacggctggctttgccgggaaacatcagattgatgtttcctcatcccagaagcccatcatcaagtgacggcgattcagttggttccgttggttccgttggttccgttggttccgttggttccggggcggcgttcgctccgttggtcctgctgacaacgttggtcccgtcaatgccggggcgatgttcgctgccggcgatttgcgcgagtagcgccatagggtgtatgctgaaaagtccggccgaaaagccggaagcttgataactcaagattggggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctcctcgtctttgggaggatgctgagcgtcgtttagaagacttgctgatgcagttgagcctcagggctgcatcgggactttaactgcggatatgctcgccatcagttgtctgcgacatcgatgggggcagaaaaatcgccaacttggccagcagactacgcacgtagaagactgtgggctcggtcatcggaccggggttcaattccccgcgcctccaccaagacaagcgtcgtttccgtaagggaacggcgcttttttgttgctgcagttgctactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggctggcccataagattctgaatctcagggtgttcgaggatgcgcagggcaagatgaaccgttcgatccaggacatcggcggcgagattctctccatctcgcagttcacgctgttcgccgacgtgcacaagggcaatcgcccgagcttcatcaaggccggcaagcccgagcatgccgatttcatgtggatcaagttcgacgaggcgttgcgctccgggggagtgccggtgaaggaaggtcgtttcggcgcgcatatgcgggtcggactggtcaatgacgggccggtgaccatcgtcatcgacaccgagcatgacatgcctgacggaacacgctgaattgcgatagtaatttgacatcatatcccgttccctccaatatgttactaaagcgctttagtcttctgcgggcgagggcgcatgtcgatatgtttcccatgaacgggcagcacaatgatgtggccgcacaagcggcagagataaggggagtgaacagcagatgttcctgaaacctgaacagcaactggagcggtgcaagcgcatagtgcgccagcgcgtggaccctcatatccacccatcgatcgcacagcttgcggtggagtcctttgacattcccggagagccgatgcccactgacgagttcttcgagaagctcaatcgaggtgacatcgacttcaagccgtttacgctcggcggtgaatggggcaccacatggggcacagtctggttccgcctgaccggtaccgtgccggccggctacccgaaaggcaagccgctggagctcatcctcgacctcggctggtacccgcactcctgcggcggccatatcgagggcctcgtctaccgtgccgacggcaccgccatcaaagctgtacacccgctcaactattgggtgccgttcatggatgctgagggcaacgcgcaagtgccggtcgccgaagacggcagcttcaccctgtacctcgaagccgccagcaacccgctgctgctcggcgtgcctccgttcattgagaccgaactgggcgaccatgccaccggcaagccggacgagccgtacgtattcaagtccgccgatctggccgaattcgatgaacgctacgagaactactccgtggatctcgacgtggtgagctccctgatggaattcgccgacaaacagtcgccgcgctactggcaactcgccaaagcattgcagcgttcgctgaacgcctacgacgagcgcaaccccgaatccgtggaagccgcgcgcgcagcactcgccggcgtactggccaagccggccaatgcctcggccatgaacgtcaacgccatcggccacgcgcatatcgactccgcatggctgtggccggtgcgcgagacccgccgcaaggtggcccgcaccgtatccaacgcattggcgctgatggacgccgaccccgacttcaaatacgcgatgagctccgcccagcagtacgcctggctggaagaggatcatccggacatcttcaagcgcatgaagcggcgcattgaagaaggccggttcatcccggtcggcggcatgtgggtggaagccgatggcatgttgcccgccggtgagtcactgatccgccagattgcatatggccgcaaatacttcaaggaacatctcggtgtggagcccaagggcgtatggctgccggacagcttcggctacaccggcgcatggccacagatcgcccgccgtgccgggtacgaatggttcctcacgcagaagatctcgtggaacgacaccaccaagttcccgcaccactcgttcatgtgggaaggcatcgacggctcgcgcatcttcacccacttcccgccggcggatacctatgctgcttggtgcaaggttcaggaactcgactacgccgagaagaacttccaggacaaggatctctccgaccgctcgcttctgctcttcggtttcggtgatggcggtggcggccccacgcgcaacatgatggagcacctgcaccgctacgagaacctcgaaggcgtctccaaggtgagcatcgaagagccgaatgacttcttcgacaaggcgcatcagcagcttgcagagaacgccggcccagaaatgcccgtctggaagggcgagctgtatctcgaactgcaccgtggcaccttgacctcgcaacaggacatgaaacgcggctgccgccaagaggaatcgttgttgcgcacggtcgaatacctgggcgcggccgccacgttggccgacccgaactacgcctacccgcgcgaggagctggaccgcatatggaagacgctgctgctgaaccagttccacgacatcctgcccggctcggccatcgcatgggtgcaccgcgaagcccgcgaggactatcgccgcgacctgaagcgtctcgccgaaatcgcccaagacatgtgcgccgtgctgcgcaaggccaacccgcaggccgacctgctcgccgaggcccgcatcagccagttccgcaatgacggcgcgtcttggcatgccaaccgcatcaacgaaccgaccgacgcgctttccgtactgacccagacattggacaacggccgtgtactgctggccaacggcgtactgtccgtcactatcgaggccgacggtacgatctcgtcgctgcttgacgaggagcatggccgtgaactggttccggccggcacccgactgggccgatacgagctgttgaaggacgaacccgccgtttgggatgcgtgggagatcgaacgcgaatccctgctcatggcgaatgccatgaccggatcaatcgaatcggtcgataccgaaaacggtgcggcacgagtccgtgtgcgtaccgccgacgatgacaccgtcatcaccaccaccatcacgctgcgcccgggttcgcacacgcttgatttccatgccgatatcgactggcatgagcgcgaacgtttcctcaaggtcgccttgccgctgggcattgtggccgatcaggcgacctacgactgccagtatggtctggtccgccgcccaatcgtcaaaaacaccgcatcagacgaagccaagtatgagagcagcacgaaccgcttcgcccttatcggcgacgccggttacgcggcggccgtcatcaacggatcggtgtacgggtccgatgccacgccgatctccgggaacgccgccgaaggtcgtgactcgggcaccatgttccgactgtcgctgctctccgcgccgaccttccccgacccgcgcaccgatatcggtgcgcatgagttcgactggtccgtggtggccaacgccacggtgggccgtgcgcttgacgccgcttgcgcactcaacgcaccgacgcttcatgacatgcccgacttagcgccgctcgcctcgatcgagtcagcaaacggcaccgtggtgttggactggataaagctggccgacgatggctccggagacctgattgtgcgcgcctatgaggcggccggcggcagggccgatgccacgctgcacgtctgcccggcgctcgcaggcgcttcggtgcatgagaccaacgtgttggaaggcgacgatttggccgccgacctgccggtcgcgctgcaagacggcacacagaacgccgaaggcgccacactgcacttcggcccgttccagctcgccaccctgcgcgtcacgcgctgaattctcgcctgacgcttctgcctccttgtaccatgaggggacagaagtatgtcgtattacggtttctccaattaccatcactcccacccctaccaccagacacagcaaaggagttgaactctccatgtttcttctgcccaatcagcagttggagcgctgcgaccgcgtcatgcagcagcgtgtcaaaccgcatatccacaccacactcgccgcatgcaccttgcgttcgttccacaatcccggcgaaccggtgccttccagtgaatttctagccaaagtgcgcaacggccaagtgcccttcgaacctttccgcgttcccggagtctggggcaccgcatggggcaccacatggttcgaggtgaacggccatatcgacatggcggcggtcaagggccgaaaagtcgaactcatggtagaccttggctggctcgatcaccgcggccccggattccaatccgagggacttgtctatcgtgccgatggcaccgccatcaaatccgcgaacccacgcaaccactggattccactcgtctacgcggacggtggcagcactgtcgaactcgatgagcatggcgacttcaccgtctatatcgaagccgccgccaacccattcgtcgaaggccccaccccgttctcacccactgaactcggcgaagaggccaccggcacctgtgattttccatacacactgagtcgtatggacgtcaccatcttcaacgaagacgtgttcgcctactacatggatctggaaaccgtctcctcgctgattcgtgagctcaaggacgacgacccacgctactggcagctcgccaaagcactgcaacgctccctgaacatctacgatgaacgcgacttggaaaccgtgtcggcagcccgtgtggcgctcgccggcgtactcgccgaaccggccgcctccagcgcaatcaaacacatcgccatcggccacgcgcatatcgactccgcatggctgtggccggtgcgcgagacccgccgcaaggtggcccgtaccgtatccaacgtgctggctttgatggacgaagacccggacttcacatatgcgatgagttccgcccaacagtacgcatggctggaagaggagcatcccgacctgttcgcacgaatgaagcggcgcatcgaagagggccggttcatcccggtcggcggcatgtgggtggaatccgacaacatgattccttccggcgaatcattggtgcggcagatcacgttcggccgccgatatttcaaggagcatctcggcgtcacgccgcgtggcatctggctaccggacagtttcggctacaccggctcctggccgcagatcgcgcggcgtgcaggattcgactggttcctcacgcagaagatctcgtggaacgacaccaccaagttcccgcaccactccttcatgtgggagggcatcgacggcactcgtatcctcacgcatttcccgccctctgacacctactgctcgtcgatgagtatgcgcgagctcatgtattcgcagcgcaatttcctggacaaggatctttcccgcaacgcaatcctgctctacggtttcggcgatggcggcggcggccccacccgtgagatgaccgcacgcatccggcgcgaccatgatctcgccggtgcgccgaaaatcgaattcggtactcccgaccaactgttcgaccgtgtgcgtaaggatatcgtcgacgatgcgcaaggggagaccccggtgttcaagggcgaactgtaccttgaactgcaccgcgctaccctcaccgcccagcaggacatgaagcgcggctgccgccaggaggagtcgatgctgcgcgtcaccgaatacctgtgcgccgcggcccgcatcaagaacccggactatgtctatccgcgcgaagagctggaccgtatttggaaaacgctgctcctgaaccagttccacgacattctgcccggttcggccatcgcatgggtacaccgtcaggcgcggaccgaatacgcgcgtgacatcgctcggctgaacgagatcgcccttgaagccgggcgcgcgatcgcagtcgtggaacccgatgacgcaaccataaccgacgccgtaatcgccccatattcccgccaagcctgtgagacgtgggtggtacgcccggcttcgagccgagccgaagcgggaaccgcatccatggctcgggtcgccgttacccatgacggcgatacgattgtgctcgacaacggccgactgcacgtgcgcattgaagccgacggcaccgtttcgtcaatcgtcgatcagcgaaccaatcgtgaactggtgcccgccggcacccgactgggccgctacgaaatgctcaaagacgaacccttccactgggacgcctgggatattcaacgcgatgcattcctcaccgccaacgcgctcagcgaggcatcgattacaagcgtggatgaaaccgccaacggtggggccgtcgtacatgctgtcactcgcgcgaaggacgttgaaattcgtacgggcattgccttaaggccgggctccgccacactggacttcaccgccgatgtggactggcatgccgtcgaacagttcctcaaagtggatatgccggtcaccgtgcaagcggtgaacgcgcaatatgaatgtcagtacggtctggtcgaacgccccatcaacaagaacacgcgcagcgatgatgccaaattcgaaagctgcacacaccgcttcgtacgtatcgccgacgccgactatgccgccgctgtggtcaacgcctccacctacggctccgacgtcagccccacccacgccgacgcggcacatggcgccagccgcggcaccatggtgcggctctcgctgctgtccgcaccgctgtaccccgacccacgcaccgaccaaggcgcacactccttcgcgtggtctctggtcgctgacgccgatatgaacgcagtgctggacgaagcggcgcgactcaacagccccgtaataggggagttgcctgatatggcgccgctggtctcgctcgccgacgccaccggcgtcatcgtattggactggatcaagctcgccgatgacggttccagcgatctgatcgtgcgcctgtacgaggccgccggcggcaatgccacggccgcactacgccttgacgccgctctcgccgatgccaaggccagagtgcaggaggtgaatctcatggaggagccggaactggacaccgaattgccgcgcgcgctcgccggtgacgagccgatgcctgccgacggtgcggtcgtttcgttggcgccattccagctcgccacgctgcgtattcgccgataagggatattgggcctaggctcgatattttgggtcgcgcccaaccgtaacggaaccggaacagaccggctctgccatacggttgggcgcggcccattattgtatgagaagagggagagcgatcccgttgggcaaatatcaatgcgacacgcgacgatgaattcgttgcgtgcatgtttcgattgtgttttactttcactaaaccgatttagttaacagatacgcggttggctggaaactaaaacggtttagtctcagcgatgagcgaataaaggttgtgacgtcaagccgattaccgcgacaggtgactgtgttggatagcaacgactagtttttctccgtccacagcagggcggggtgaaaaaggaaccaaaaggaaaggaaaacatcatgttttctatgaagaagatcctcgccatcgccggtgccggtgcgatgctcgtatcggtggctgcctgtggtagcggaactgcgggggatgacggcggcaagaaggagatctccttccagacctggaacctcaagaacgacaagtacaccccgtatttcgaggcgctgatcaaggcctatgagaaggaccacccggatgtcaccgtcaagtggcttgacgccccgtccgatggttacgaagacaagctgtccagccaggctgcggccggcgaactgccggacatcgtcgacggcggcaactccatcctgtacggtctggccaaggctggcgcgctgctcgatgtctccaagcaggctccggatgcggaaaaggactactacgaaggcgcatggaagtccgtgaccatgcagggcaatggcgtcgagaagggtgcctacggcctgccatggtatgtcaacgatggcccgacctactggaacaccgagctcatgcagaagtgcggccttgatccgaacaagattccgaccacatgggatgaatacttcgccgccggcgacaccatcgtgcagaactgcaaggatgtctacctgggcaccacgatgggttacaacgccgaagatctgatgaccgcaggcgtcaagtccttcatgaatgatgaccacagcaagtacaccttcaatgatgaggccggtgtcaagcagatcagccgcttcgttgagctgtacaagaagggcggcatcccgccggaggccctcgactcctcttggagccaggccgccgatctcttccagcgcggcaacttggtctccatggccggctccgcctactccgctgacggctttaagcagaacgctccggacctctacaagaacctcgcagtcggcccgcgtatcagcaacgacggcaagtccgcttccgtggcctacgagatgctcggcatcagcgccaactcgaagcaccccgacgtcgccatcgacttcgcccgctttgtgaccaacgagaagaaccagatcgagttcgacaagaaggcctccgtgttcccgtccgctaagggtggtctggatgacgactactacaagagcattgacgagagcacccttgagggcaaggctctgaagatcacgctcgaccaggtcaaggacggctacggttctcgtccggccgagtttaccgacaacaacggctacaagaacttccagcagcagatcgccctcgccatgcagggcaagcagaccgccaaggaagcccttgacaagtccgtcgagttcgcaaacgagaagctcgcacagtgagcaacgcggcactcgccgctgacaggtcggaggcccgcacggcctccgaccggcctgaaccgatgaatacgcgtcacggcaagaagcaggatcgcaagttcggcaccatcattgccccttacttgtttgttctgcccgcattcgtgattgtgtttgttttcatcgtcctcgcggcactcaacactttcaggcttgccttcaccgattccacgctgctccgtccgggcaaattcgtcggattcgaaaacttcatcaaactgttccacgacgagtacttcctcaccgcactgctcaactccacgatctacgtgatctgcgtagtgccgttcatggtgatcctcccgttgattctggcctatctggtcaagggcaactcccgaatcatgggcttcttccgcaccgccttctacatgccggtggttatgtccgccgttgtggtgggcatgatctggaccaacctgctggattccgccggtctggtcaactccgtgctcaaggcattgaagatcatctccaagccgattccattcctcaccgatcgatggggcgtgctcttcagctcgatgttcgtgacaatctggctgggcctcggctactacatggtcatctacctgaccgccctcgccaacatcgatgaatccctttacgaagccgcctccctcgacggcgctggccctgtccgccagttcatctacgtgacaatgcccggcgtgcgctccacgatgatgctcatcatgatgctgtccaccatcgccgcattccgagtcttcaacgagatctacgtgttgaccaacggctccgcaggccccggcggcatggatatgacgatgtcgatgcttatcaagcgcgaaggcaccggtatccaggcccgcactggttacgcgagcgccatctccatcgtcgtgctcgtcatcgtcggcgtcatgctcatcgtgcagcagatcgtacaaaagcgaggtgaggactgatgaataccaacacgcataaggtcaccgtcggcaaagtcgtccagtatctgattctgattctgatgttcctgctgctcgtcggcccgttcgtctgggaactgtccctgtcgttcaagggcaagggcgacaacgtctacgccgtgcctccctacctgatgccgaagaccccgacactggagaattacatttccgtgttcaagcaggtcccggtattccactacatgctcaacacgctggtggtctgcctgatctccatcttcggcaacgtggttttctccacgatggccggctacgcactgggacgcctgaagtggcgtggccgcggactggtgttcaccatgttcatgggcaccatggtcatcccgatcgaaggcgtgatgatctcccagttcctgatcattcgctccatccacctgcagaacacgctgctggcagtcgcactgcctggcctgtgcggtgccatcaacatcctgctcatgaccaacgccttcagatccattccaatggaactcgaagaggcggccatggtggacggtgccaacctatggcagcggttcttccacatctgtgtaccgcaggtcaaaggcacgatgaccgttgtcggcatcttcgcattcgtcggtgcctggaacgacttcctgtggccgttgatcgcgatctccgatgaaagcaagtacaccttgaccctcggcatgaaccgactcaagggcatgttcatccaagatccgcgactgattgccgccggcgcgctcgtctcgcttatcccgatcatcgtcttcttctgctgcttccagcgctacttcttccgtggcttggaacagggcggactcaagggctgagcggactggaaaaaggagatactccaatgaaattcggagtcaactacacgccgtcgcatggctggttccacgcatggctcgacccggactgggacggcatcgacaacgatctcaagcagatcagcgaactgggtatggaccatgtgcgcatcttcccgatctggccgtatctgcaacctaatcgcacttggatcaacaagaagggcgtggcggatgtgcgccgcatggtgcacatcgccggcgagcacggtttggatgcctatgtggacgtgttccaagggcatctgtccagcttcgacttcctgccttcatggctggtcacctggcatgcgggcaacatgttcaccgatgcggacgccgttgcggccgagcgtgaactggtcaagaccatgaccgatgagctgtccaaggaacccgcgttcaagggccttaccttgggcaacgaggtcaatcagctgtctgacaggccgcatcctacgaagatgagcgccacgagccagcagatcgatgcatggctgaatgcactgcttccggccgttgccggcgaagggcataacgcactgtacagcgtcaacgatggcacttggttcattgacgggcacccgttcacgccggtgcagtctgccaccaagggcgatatgaccgtgattcactcctgggtgtttaacggtatcgcgcaaggatacggcgctaccagtgaggaatgttcgtcgtacgcactgtacttggctgagctggccaaggcgttcggcaaggattccgagcgtccggtgtggcttcaggaagtcggtgcgccggagaatgtgctggaaaccgactacacgccggaattctgccgcaagaccgttgaacgtgccatggattgccggaacctgtggggtgtgacgtggtggtgctcgcacgatgtgcccgccagcatggaagacttcccgttctttgagcactctctgggcttgttcgacgagcaaggccagctgaagccgattggccgtacgttcggggagctcgccgcacagtaccgttccgcattgccggctcagccgaagaccgtcgccgtggtggttgatgtggacgaggccggaaacccggtgaaccgcagtgcgctcggcccgggaggttcggtgtgcgacctgtggatgaagctgcaggtggcaggccagcgcccgaccatcatcacctcgcaggtggcggccgatcaggcggaactcgcgcgtcgcggcatccttgaattgcacgccgacgagcacccctacgccgcccgctactacactgcggtttcggacccatcgttcgaaacggctgactaaaccgatatccggttgtggaatcatctactccttgttccgcaaccggatattttcaattgccgtgcgcacaattgcggtgcgcagtgcacaacataagaccctgtactcgccgaagagcgggaagaacgagaagttatatacgagagggggcgcacccgatgagcatcaatcacgccgcagtggaccgactcattgattcgatgagcttcacgcagaaggttggtcagctgaaccagcgtctgttcggttggaagtccgtagaacgcaatgccgcaggacggcttgtggcctcagacgagctcaagcaagagatcgaccggtggggcgggcttggcgctttgtacggcctgctgcgagctgacccgtggtcgggccagcattggggcaatggcatacgccctgaggaacggcctgaggcggttgccgtggtgcagcaaaccgtgttggagcgcggtgcacatggcatcggcgtattgctcagcgaagaggctcctcacgggcatcaggcgctgggcggcgcggtgctgcccaccaatctgggattgggtgccacattcgattcgcaaggagtgcaggaagcggaagccgcagtcgccgcggaactggcagccagcggtattcatattgcattggtatccggtttggacatcgcccgcgacccgcgttggggccgttgcgaggaatgcttcggcgaggacccgctgatggcctcccgcatgtgcgaggccatcgttaccggtatgcagggtgagcatcgcagcaaggtcggccgcgggggagtggccgtggtgctcaagcatttggcggcgcaaggcgaggctgtgggtggccgcaacgggcagtccgccgtattgggcccgcacgatcttcacgagattcatctgccgccggtggccgctggcgtgcgtgccggtgccttgggctttatggctgcctacaacgatatcgattccgtgccttgttgtgccaacccgtggttgctcgaggattatctgcgtgaccagctcggttttgatggcatcgtgatggccgatggtctggccgtggaccggcttgaagatatggccggctccattcccgctgccggacgcgccgcactgcttgccggtgtggatgtctccctgtgggatgaaggattcgcgcgcctcgaagaatatgtggatgacgaacaggtggcggccgccgtcgatacggcattgcgtcgtgtgctggagctcaaagccatgttcggtctcttgcccgaagatggtgccgataccgccgcaattgccatgccagatgccgatgccatcgcgcaggccactgcggatgggcgtgagcaggccaagcgcatggcccgcgaggcgataacgctgattaatgatggccgctctgccgttacgctcgacagcattcggggtgtgctgaccgatgcccaagccggccctgtgattgtcgccggcccattcgccgacgatttcggctgcttcctgggcgattacaccgcccctctgcccgccgatgagcagtcaagcatctaccggcaattggtggcacgccttgggaaagaccgggtttgcttggcggccaagccgagcgatgtgtcggccgatcggtgggcgagtgcggcagccgtggtattcgtatgcggcagcaccagcgaacgcagctatgacagtgaattcgacgacaatggtgcggcaaaggccgtagccgaatacggtgccacctgcggtgaaggcgtggatttgtccgacatccgtctgccttggcaccaggatgaaatgctggacgaagtcgtggcattgaccaccgctccggttgtttcggtggtggtgtgcggcagggcgcatgtgctgactcatgtaataggtcaatccgccgtgacgatttgggtcggatatgctggccagtatggtccgcaggccgtggctgatgtgctgattgacggtgccggtttgccgggccgccttcccgtaacgctgcctgcgcatcccgcagccattccggttcgatacaacgaccggcaaagtgccgcccacgtatacaaggatgcggcggaaccggtattgcgcgagtttggctacggagccggttctttggctggagtgacgtttagtgggatgcatgccgatgccgaatcccgcgcgaatgaggtgttggtgcaggtgacggcacatgccggcgaccataagacggccggttcggtgaacctcttcgcacacgtcagtggcggtcgtcgcatcccacgcttggcagtgctggtcgattccgttgccctgacgcttgaggcgggcgaaagccacgcggtatcgttctcggtaccctttgaacggctgatggacgaagctgatgacaatgtgcgtgtgacgtttgccctgacagccgctttgaataacgatgatacccgacatacagacgactgcgataccagcgtaagcatcgtgatacatcgctgacgatgtgcatgagacaagtcggagaggggtatgttccgtaagtctcatgacctactcattgcggccgatatggtcggtgggtgagagaaaaagagaatgtgggatatggcgttggtgaaatatcgccgtatcccgtgggctcaaaccgtcctaccggtttgagcccccgtctactcaagccgcatagacggttgatttccggcgtgagtcggaggaaatcaaaggagattatggatgagattgtcatcaggtgatcacgctgggcgtgcttctgcccggactcgacacaggaaatggctgcggtctggcttggcagcggtgctgtcgatggccacgctggcggcattggccgcaccggcaagcgccaccgacaccatgccgtggggaggccagtatgccgataccagccatccggagcagtctgcgggagccaaccagccatatcagcatggctataccggtctggatattctgaactggaacccggacgcggataaggactcggaatacctgcgctcccgtgtaccgttgcagacccgcatcgccgccaacgccgcgacgcagaaagacccgaacctgccggccgatacggagatgttcaaccttgctggcgactacggcaacgcgttcttcgagtcgttccacgacaacaacgtgttctcgcagtacctgttcaactactggcagtacacggattattacggtacctggcatggtcagccgactgcgaacgtgccaaagagcctctacgacgagaaggcccagtctgactggactcagaaatggtttgagttcggtacgttgaatctgccgaatgccgcatataccaatgtcgcgcacaagaatggcgcgaagtcgattgcgacgatcttctattctggcaacgaccgaggagaacagacctataaggacctgcttcaaggcaagcgtgccgacggcacctatccggtggctgacaagctggtggagattgccaagtactatggttttgatggttacttcgttaaccaggaatccagtgtgaattctgctgatgtgccggcctaccaagacttcatgaagcagatcatcgatcagggcatttatatccagtggtacgactccgccacatacccgaatggcggcgtcagctatcaaaacatgttcaacgatgccaattcgccgtgggtgcaggatccgaacaagggtaaaatctctgattcgatcttcctgaactactggttcagcggcaacatgctacaagattcagctgatcacgccaagagccttggcattgatccgaagtacgcggtattcgcgggtatcgaggccggacagaagaaatttggtagcatcgccagcaacgcgaattatatgaatgtcaaccttgacgctgacggcaagccctatgtgagccttgcggcacttggcaccgatttcgtctcccacgagttgggtgacgacaagaaggtctacccgaagtatcagaaccaggtattcgaccgcgaacgccgtctgtggactggttcgtccaccggtgagaagggcacgacggatatatctgatccgtatattgatgatggtacgagcagcgatagctggaagggtttcgcttcgcagatcgccgagcgctccgtcatcggcggtccggtcttctccacatcgttcaacaccggtcatggtctcgaatggcgagacaacggcgaacagaccagcaaccagcagtggggcaatatcaacctccaagacattctgccgacatggcagtggtggattgatgccgattccgacccgctgcaagccgacttcgactatggcaagaaatatgaagcggcaccacgctttaactacaccaaggtcggcggctacgaaggcggcgattcgctggtgttgagcggcaagctgtccagcgacaacaccgtccgtctctacaagaccgacttgagcgtcgctgccggctccaaggtcgaactgacctacaacaagctcaacagcgacgattccaagctgcaactcggcctcattttcgccgacgacaccaagactatagtgccggtggacatggcagacggtggggcaagcaacggctggaagaccgcaactgtagacctctctcagtacgcgggtaagaagatcgccaccctgggcctgatcgtcaaggccggggcgaacccaatcgacaattaccaggtgaacatcggcaagattaccgtcaccgacggtgctgcctacacgccggctgctccgacgaacttccaagtggaacgcgcctacgcggactccgacgaactgaccgtcaaggcctttcgctgtttggtgtgggtgagtgggtcggggggtggtggtgctggtcggcgccacggtcttcgtttcggtggcttctggtcacctgaccctccttgcggtaggttaggtgttgcaacgatcactagaacccgccctgtcgagcgtagcgagactgggggggagaacacccttttcgatgagggtttgaccaaacgtgccaacctcgtcctcacccaaacccgctacctctcccgccaatacgccgcggtagtggccaacccgccctacatgggttcgggcaacatgggcaacgagcttaagaagttcgtcaacgaccattacaaggacggcaaagccgatctcttcgccgcattcatatatcgcctgctgttgatggttcctgagcatggccgacttggctttatgtcgccatacgtgtggatgttcattagttcttatgaacagctacgtaaacaaataatcgagcacgagcatatatcttctctgattcaactggaatactctggctttgatggtgctactgtgccgatttgtacttttgtgctcggcaaaggacaatcgacagagcatagttcctttgttcgattaagtgattttgttggtgcaaaacaacaggctccccggtcgagggagattattgcagctcatcgcgctgttgctgagggtttatctgttgaagatgcgccaatgtccaaacatttctacgtctgcaaacaacacgatttcgcccaaatccccggctccccaattgtgtattggttcccggaagagcttctaaataaattcggtacacaatcacttggcagtcagatgcggttcgctatcggtatgataactggcgataataatcgttttgtacgttattggtttgaggtttcaacgtctgaaactggctatggaatgactcggacacaggctgtggaaagtggggccatatggtttccctatgcgtccggcggcgagtttcataaatggtatgggaataataccaaattggtgaattggaagaacgatggccatgcactccagacagttaaaacagcagatggcgcgagagtccaagctcataatttcaatcttgaccgaattttcaagaccggaataagttggacgacaattacgagtggagaaccctctttccgtattcaagataatggattcctttttgcggatgctgctggtgtcgcacagggggacaaggccgttgaagcacttggtatgttaaattcttcatattcatcatttgttctagggggtatcaatccaactattaatatgcacccgggctacttggagaagttacccaagctcattttcccggatgatgatctatgcatgtctattgtcacgagtctggtttcggtagctcgctcggactggaactcttatgagacttcgtggggtttcaccagattagggattctagatacgattgatattaagtcttctctgcaggtgattcctatgagggaagtaactgaggatgtcctcgataaggggagtttacgcacgatcattccgacatatatcgaacgatgcaaacatatcactgaagagcaacgtcaacgtgaaatcaagaacaacgaactcgtggcggacgcctacggtgtgcgcaatgaagtgccatgcgacgtaccgatcgaacgagtgtcgctgaaacgtaatccagcattcgcatacccgaagaacacgcctgccgagcgtgacgaactcatgacgcgagatatcgtcaaggagatcgtctcctatgcggtcggctgcatgttcggtcgctactcgctcgacaagcccggtctgattctcgcttcccaaggtgagactctcgccgactatcacgcgcagatcccgaatccctcgttcgagcccgactcggacaacgtcatccccgtcaccgaggatgaatggttcgaggatgacatcgtggcccgattcaggcagttcctcagcgtggccctcggcgagcagcatcttgaggagaacatagcctacatcgagcaggtgctgggcaagtcattgcgcaaatacttcgtcaacgatttttatgacgaccacgtcaagatgtacaagaaccgaccgatctactggatgtactccagccgtaccgacaagaagggcgcgttcaaggcgctggtctatctgcaccgctacacgccggccaccaccaacaacgtgctgtcgtaccttcgcgacttcaccgccaagcttcatgcccagtccgaacggctcgcgcaatccgacaaggccagcgaggttcgccagggcgaaaagctgcaaaccgtcatcaaggaatgcgccgactacgagcgcgacatcctctacccgctcgccacccgcaacctccccatcgacctcgatgacggcgtcctagtcaactacctgcgcatgggcaaagccctccgcatcatccccgcaatcgaaaagaaacgcaccaccgtccaatcctggacctggcccattcatatgttaggagagtgatttgatggcgggatcgttagctgaatatgatgcacttgaagattgcacacgcaatatttttggccgtgttatgtggtctcacaagatacaggagaaacaggcagacatttatctatttaagtcaaaaaggttgacaatatgcagtattgtgctttcttcgattgtgtcaggcggactcgtagcagcgttatttattgaccctttttggctaaaattggtttcaacattaatgtcttgtatttcgacaattctgattgctgtcattaagagatttgattttgaaaaactgattcaaaatcatagggaattcgcaacccgatatcttgcagtaaaagatcaactaatgttactgctttatcaaatacgtttgcatgacaaggatcgcgatttcttagaagaagagcttcgctctcttgtttcaaaggtatctgaaattaattctatagcgccacaaactacaaattgtgcagttagtctcgcgtcagctgccttgcataaacataaagatgatgacataaccgatgaagagataaacagtgggctccctccatcactaagaaaggaatgtaagaaatgaatttttacgttcagaagcatgctggagttatcaatcaagaaactcgtgggttaatcgcgaaaaggtaccggactgttactaaggctattaaccgagagttttataattcgtatagcgaagttgagcacagcttgtatgtaggttcttatggtcgttacacagcagtcgatacaagtgacattgacattatggtaattcttcctcgtgaagagtatgaacattatgattcgtatcgcggtaatggacaatctcgattattgcaatcggttcggaatgctattaagcaagcatattctatgagtgatgtacgcgcagatggccaagtagtaaaaattgcctttagtgatgagatgaagtttgagatactgccggcttttgtctctatggattggggagggaatactatatatgagtatcccgattccaaccaaggcggtaattggctttcgagtaatcccaaggctgagcaagaagccataaagcaaaaaaatagatcttctaatggtctgcttgttgatacctgtaggcatatgagggtggttcgtgactcttgttttaaaagctaccatctttcaggaattgtcattgacagttttgtttattccgctattaaagattggcgttggtgtaatcccggtgttccttcttcctctcctaaaggttcatacgaggaaataattcttaggtattgggaagactccattcagttttctcctaattctttgacagcaccaggaagtggagattccgtcaatgtgcagaagagcaatgaatgcttaggtaaagtgctgcgatatatggcgggtaaataacaacgttggtgattatatgagcattgatagaggtgaatcaaaaaaacgccgagtacaaagtcgctctacctgaccgcagtatcaagtacacgaagactgcggttgcgttcgccaatggcgagggcgggcgtatcgtgtttggcatcgaggactagacactgcgtgtggtgggtgtgccggcaccacacggcaggcggatgccgccaccatcaaggaactattgttcgagggcagcaaccggagcttcgaccagggtactgaaaatgctcggaaaatgcactcaaatggtgttgagtgcactgacagtgcgctcaacgtgcacggtgagagcatcaacagtgaatcgatggcccggcttgacgaacagcaacgcaaagtgctggacatgcttgtgcagaacggtccaatgaaatcgtcatccatagcggatcagctgggtgtgcaaaaaagacgtgcgatagacatactgaatgacatgacggataagggagtgattcagagaatcggtgtcaaccgctcaattgcctatgcagtacagcgaggagcacaaaaatcgcgcgaggtcatagatacgctataagctgattcattagtcagtagcaatgcgagacttccaagagccgggggtagtcctccggcatttttttgtatggagggagcggtcaatgtcgattatcggcggacgacgggcaacctgtggacggagaagaggacggtgaatgagcggtaatacgcagattggtcgtttgttggcgacacgtttcgcgccattcgacggcactccgcatagcgaagggcgcgtggttttctggcatgacgaggtcggtgaattctccgaagaagtggacagcatcgttgggccggaagcggagaacgaagcgctgcgcgatgttgagctggttcgtctggaacgcaatccgttcgcactgaaataccggatcatgcttgcagaaccaaccaccaaattcctggtatatgtggaaggcaaactgccggccaatgaagacaattggctgctggatcttgaaatcgcctatggtccttggttcactgcggacaagctgtcgatgatcctcaacgagttgttcccgcgtgaggcatccgccgaaacgcgccgtgattggctcgccatcatgcagcggtgtaagccgttctttgatgatgacgatttggttcaagccttgcagcaacgattgcgtgcggaagacgatgccaagaccttccaagcgaagatgatcgcatcgctgctgggattgccagtcggcgaacatagcttgcaggccatctggcgggagctgctcacgcaatacgccaaagactccgctcgcggcatcgagacaatcgaggccatgggattggccgactaccactgggcgggcacgcgcggcatctacagatttgactccggcaatcaactgaacaagcccacggtgaaggatttcgtgatctggctgttccgtctcgcctggaacgggttcagcgatgccgagaatagcatcgactattacgcgaacgtccgccgcgacttcgatacctggcgcaataacccgaaaaccactccggtgatacagaggctggcgagtgaggtgtttccggatctgtcgctggatagcaccatcgccaccatgagcctggccgaactggaacagcacgacgtattcagtgaagtcgacgagcaaatcgtggaactgctctatgaggcattggacaatgcggacgtgaccgatgaagacgtgcagcgcatcatcgccgcccgccgatacggcctctggttcacccggttcgccaatgattacgacatcatcgcgtccgcgagcgcgctgcgtgccatgctgcggcaatgccagcccattgtggagtccatcacttcgccgcaaagtggattcgaggcttataccaattcgctctaccaagtggacggctgttaccggcgcttcatcgcggcgtggaaaatcggttccccatcgcgggacagggacatcgcggacagtctggaacgggagtactccaggtaccagtccgagcttggcgtcgcatggcagcggcaggtcggcaagatggacagttgggcgattgcgggtataccctcccaaaccgagttctatgcgcgcaatgtgaagacggtgacggatgcgcataagaagattgcggtcatcatttccgacgcgctgcgttacgaagtcgccgaggaattctgcaggaagctcaatgagcaaagccggtggaccgcgtccatggcggctcaactcagcacgctgccctcgtatacccaattgggcatggcggcgttgctgccgcatacggacctgtccttggatacaaagaagcattattatgccgttgtggatgggaaggatgcgagcggtacgccggctcgtgccgcgattctcgccgaagtcggaggctccgccatagaggcggaggatctgctcaacatgaagcgagatgaataccgcaatctggtgaaatcctgcaacgtgctgtacgtgtaccacaacaccatcgacgccattggcgataaggaagccagtgaatccggaaccttcgaggcgtgcattcgagcaatcaatgagcttgaagcggtagtgaagcgcctacccaacgcgaacatcaccaatatgatcgtcactgccgatcatggcttcctctaccagaatcacgatgtatcggatgcggaatggctcagcgaacggccatccggcgacgcgatatggaaggaaagccgacgcttcgtcataggctccaatctggttggcaagtctgcatttacgacattcagcgcggcgcaggttggcttgcgggatatggcaggcgaaggcgtgaccatccaggtgcccaatgccatccatcgccttcgtatcaaagggccgggcgtgcgatacgtgcacggcggggcttctttgccggagatcgtggtgccaatcgtgcacatcagcaaggggcggtccgcctcggaagacgtgcgcaaagtgagtttcagaatccagcagacgaccgaccgcatcaccactggtcagatcacggtcgacttcctgcagaccgagccggtgggcggcaaggtgtccgaacggaccgtgctggccggcttgtggggcgtttcggcggacggcaagggtgtgctcatctccaatgaggtgcccattgcattcaactccaccagcaaggattccgctgaccgccacgtgcctgccacattcctgctggccggcgatgccgaccaattcaacaacacaaccgtcgaattgcgtgtgagcgagcagattcccggctccagccagatgcgccagctggacgtgaaggcggagtatctgctcaagcgcggcttgttcaccgatgacggattcgatttctgaagttgaatgtgtcgttgccgaatgtgtctttggtgaaatgagattgggcgtaaggtgggattatggcagatgaatccaatgaggtgagcgggtcgttgactggtgctggtgctgagggcggcgtggcggctctcgtaatgagcaatctggaccgcaagatcaccgatgacttctcgcaatacacggtgcgcaaggacctggtcagcgaagtcaaaggcaatgcgctggtgccgtcgtatgtgctggaatatctgctgagcaaatacgcgaccaccaccgaccaggagagcatcaatgccggcgtgaagcgcgttcgcgacattcttgcggacaattacgttcatcgcgaggaagcgaacctcatccaatcgaagattcgcgagaaaggccgataccaggttatcgacaaggtacaggtcgcgcttaacgaaaaactcgaccgttacgaggccacattcgagaatcttggcatcagtcgcgtggttgtcgattccattacggtggacaagaatcccaagctgctggtcacgggcatctggtgcatgtgcacgctggtatacgcctattccggcgaccgcgacgaggtgccgtggcgtttgcatcggctcatgcccgtgcagatgtcgcatgatgaccgcgaaaactatctggccatgcgcgcgaagttcaccgcgggggagtggatcgacctgctgatgcaatcggtcggattcaacccggatctgttcggcgaccgcgccaaactcctgcacttggtgcgcatgatcccgttcgtggaacgcaactacaatctgatcgagcttggaccaaagggcaccggcaagtcgcatatctattccgaattctcgccgcatgggatgctcatttccggtggcgaggtgacggcggcgaagctcttcgtgaataatgcgaacaagcagatcggcttggtgggctactgggatacggtggcgttcgatgagttcgcaggcaaagccaagaaggccgacaaggctcttgtggacatcatgaagaactacatggccaacaagagcttctcgcgcggcgccaatgtgacgcaggccgaggcatccatggtgttcgtgggcaacacctcgcacaacgtgccatacatgctcaagaactccgacctgttcgaggagctgccggtgcaataccatgacccggcgtttcttgaccgcatccactattacctgcccgggtgggaattcgagcagattcgtacggagatgttcacgagcggatatggcttcgtggtggactacctggcggagatattgcacaacctgcgcaacgtggattacggatcggcgttcgagaagtatttcaagctgtcgccgtcgctgtccacacgagataaagatggtgtgcgtaagaccttctccggcctgatgaagctgatctatccatccggacaggccacggccgaacagatggaaccgctgctgcgttgcgccatcgaagggcgcaagcgtgtcaaggatcagctgtgccgcatcgactccaccatggcagcggtggatttcagctacacgcgggctggctcggtggagccggtcgccgtgcatgtgctggaggaggatgattacccggagctgtattggcgcggtgggcatgatgagcgtgacgaggcagagagaggtacggttgctcctgttgcactcgctgatgacgctagtctcggtgttgagaaggttgataacactacttctgacgtgcctgctggagattccatcggttctgttgatgacaaagctgctgcctcagctgacgtaactcataaagttgataacgcgaatgaaacagagtcttcgtcgccagtacttgccactgagtctacggctacgtctttgtctactcttgcgcgcgtgccatctttgtctcccattgagcgtgccgctacaacggccaaggaaggacatgtcgaattcgctgaaagccagcgaggtgccacatataataagctgttcggtccgtatgtcgctggtgcgacgcagattacgctcaaggacccgtatattcgtaagacttatcaggtgcgcaacctcgcggagtttcttgaaaccgtgtacacatacactaatcgttcagacgaagtgcatgtgcatttgattaccggatgcgatgaggagtatcccgaccggcaaatcgataatctcagccaagtgcaagcaacgttcggcacattaggcattgcgttgacctacgaattcagcgagtccgggcacgatcgttccatagtcaccgacaccggatggcgggtcatcttgggccgcggcttggacatctaccagcgttacagcgacaacgactggctcaatccactgaccaggcagcagaaacttcgtcgcgtgaaggaattttcggttacgtatcaaaggagatagtagagatgggctatgtagatgaaggatatgaagaactctattctgatataaatcggttggggagaggaccgcaggaatcatatgaagctctgtgttcaaagagtgattctgaagtacttgatttattttgggatatgtatttaagcataagagaaccgaaagtgcagccttctctcttctctttctctccttcgcaatcactttctggaggtagatttccttgtgcagatattaattgtcggctaaggaatgctcaacgattatgtaatttttctgtgatgtatgcggataatgtcttcgttccttttcctctcaatgatttactaaaagaggcagaatccaattcatctctagatagaaatctatttttagatgcattgattctcattaaaatgtatgagccacttgtgagggctggtttactttatttccagcctgatttagttactacttgtcctagttgtactgtacatctcaatcagattcagcaaactttccaaaatagatttgaatcaattggttctcctgtcattcaatctgttctaaattcgttgcaggtgtatgtcatgaaagaaggcgaagaagtatatcttaagattcttccttgtccagaattagggatacaagaaagttcgtttattcattttagatatgaagttccttcagttgttttgtctgccttgaataaggatggaattggcgcttctctcgattttgagtctatgcgagagattggcttagcgcagcagatttttcaagagattaatgatgatttgtcaatgtataatgagcaaaatatcgaagcgcaatgttcataccttacagacaggccatcggatcttactgttttgaaaggcatgagtgacagtgtctcgtttgaagatatatctcattatcgaattttgtcgcagcttactcattccattccatatctagcgaatatctcaactgaaaaaatactaaaattgagaaaagaagaaggggatgcttttgataactacagaagctcaattactaaggcgatgaaatctgtaaaattagttacagctaatgattacagggatttttatcgagatgagattcaatgtggaatcaataatattcaacatgcagtaaagaatgctaaaaatacctatatgagtgatgctttattgatggctgggtctatctgcattagtgtggctcagctagggatacctccggagttggccccagttgcaagtctcgcatcaggtgcattgggggcggctacagttactgatataatacgtaagcatagagaaaatattaatggaactaaagctatgggttattattttttgtggaaattaaatgagtagtattactccattgtggaagcttgcttcgctgccatatcgtggataattcggcatcggtgaggccgtgttagaagaagagctcgattattgggcttatgtcctggtccatttcgtccgaagcaggggcttcctgttggatgcgcgtcttgcgaaggtgtggttgtgcggcaatatgaccggtatcgtgaaagacgtgctgattatttgaaggtttgagcaccggggttattgcgggacggcaccggcgtgcgtggcattgggcaccatcggtgccgtccctgttcgtggtggttgtttgatggttacttgccgggtgcgtgttccctcatgttgtagtcgccggtttccagctaggtggtgttgcgcacaatccgttccatgatggcgtcggcgtgggtgccgcctccgattcgttggcgccagtccttttgggggtattgggtggcgaacagggtggtgccggcatcattgacgttcttcgatttgcatgcggtattgcaggaatgctttatgtggtacggcgagcatctgttctgcttctgtgccacattcccggatgggaagcaggtgcaagtggaagaattgtggggagaagagtcctcataccatgaggcgaaatacgaacaatatatgccggtggagccgttgccggaagttcgcattgcttcggaaaccgagctgggcgacgtgtttcccaaggcgcgtaccgctcgctattactacgattatggtgacgattggatccatgatattaagctgatgcgtacctaccgcagcgtgcacgttgcggatcctcagctttgggatggggcgggggatgcgccttcggaggatgtcggcggggtgtatgggttcgagcggttccttgataccttgggcaatcccgaagatgaagaacatgatggcatggttgagtgggccaagaatcagatgtgggatcgtctcacgctgaaccgccatcgtgagcgtctgttccgttggcacaagcaccgtgacatgatgctgcagtagatggcgtggctacaatatgagcagctgtcagcggaatagccgtttgtggcttgcggactaggggctgaaaatgctataaatatattgctttactcggaaacgagaaaggctccaagtcgccggggggctcccccggcattttttgtcaacggggacgggggatgcgatgccgtctgtattgagcatcttcgctgatgagagcggtgagtggggtaaacgatcagaatattatttaattactcttgtctttcatgaccagtctaaggacattagtcttgccttagagcggtaccgccagtcgttggctgactatggacttcctgatgtccctttccatgctgggccgctgcttaccgggcatgatgcttacgaagggatgagcctatcggagcgtaagaggcttctgggtttattcgttatcatgactcggcggctgccgattacatatcggacgtttgtgcatcgtaaaagtgattttgacgataaccgccaacgttttgaagcgcaactcaaacgcgatattgttaatctacttttggcgcatctttcggatttccattcttatggcactgtcaaggtgtattacgacggtggccaacagatagttactgatgccctgcgaggcgggattgagtatgcactctcaaaagatgccattgtctatcgtgacgcttctccacgcgactaccggcttgaacaagttgcggattttctatgcacccttgaattgacctgtgagaaattccggaatggggaacaaactgaaacggacaacaagttttttggtgattggaaatccttcagagtcaattatcttaagccgatccgcaggaaaagattggaatcataaatttggcagtgcccatatatattcgggacacaattgaataacacgaaatagcaaacaaaatccccggacctacacaatcatcgtcacgacaatctcagaaaacaccgttacggcaatcagtggtgtggtgccgtcgatgaaagcgggcatgggtggcagatgatagtaggcgaggtagcaggccatgtcggcgataagcaaaatcagcaggatgatggccaaaacgatggcggcggttgccctgagagctccggaactgtgcaacatggtcagcgcacatagttccagcgtgatccacatgacgatgagcaacagttccgtggtgatcggccgttgcaacagtagcgaagtaagcacggccagaatggtataggcggcaacgccaccgaccgcgaaccgctgaatccgccgatttcgccggccctattaagtccctcaactccatcaatcgccgtctgacccatcacatcacgctttcatacacattgccgattgacagtcctagaacacagcctagaactgtcatggcatgttcgtgcagataggggctccaacaaaattggctaaaagagaacttggcaacctataacaaggacgcgcccgtgtgcccttaccgttcagctccgctcacgaatgaaatcgaagatcacgtcgaagacctgctggctccagaaatcgtactcatgttcggcgccgtcgactagcaccagctgcgcgtccacgccgtgctcgaccagttggtcgcgcatcttgacggattgatgataggggaccacggtgtcggcggtaccgtgcaacaggagcatcggcggatactgctggtcatcccgcacctgcaggtagggactcatatcagccgcacgctgacggacctcggcattgatgccggtctcatgggtcgcgcccaccacggccgcgaacgggccgaaataatacagccggaatggattggtctcatcgtcgaatgcgtcgactgcttcaagcatgtcggtgggcgggaagcagctgaccacgtacttcaccgcatcgctctcatcgacattggtgccgtcctcataccgtggatcgtcggcggtcaaccccaccagcagcgacgtgttgccgccggacgacgtgccccagataccgagacggtcggggtccacgtgccattggcgcgcgtttgccctgagatagcggatggctgctttgacgtcctcgagatatgcggggaacatgtcatggggatcgctcgaggcatcgcgatgattcaccgtggccaccacaaagccttcgcgggccaaagccgagagctgcgggatctcgtagtcgcgatgcggcgtggtccaggcgctgccttgcacgaataccacggtggggtagcggcggtcatcgtcatcgccggtggattgtggtgagatgatatccatcactaggttatcggccccggtcttgtacgccacgttgcgggtcagcgtggccaatccggcaagcgtgggattgtgcgggatatgaatggcattgtttgcgccggcattggcatcggtgactttggctgaatcggcagtgttcatggaatccccctagctctgttgctatagaggtcatcatacaagaaataggcatgattacggcacaacgatgtctcggtcacagcgaagacatgaaggcgcgaagacgcgcccggcagcgcgcgctgcctgcctgcgagttgccttcaagtgcacttcaagcgataaggtgacataagccgcggcaatggagattgctgcccggcaacgaggcggacagtgcccgttcgccgattcacgataacagaaatgagacactatgaagactcaggaaatcggacaatccggcatgattgcgtcacgagtggcgctgggtgtgatgcgcatggacgcgttggatgccgccgatgcggcacgtaccgtggccgtggcccatgattctggcatcgactatttcgacacggcggacatctatggattccatgatcatgccgcgcacgccagttcgaagcgtttcggccaagcgtggaaggacgcaggactcgaccgcagcaccatcttcatccaaaccaagttcggcatcgactacagtttcggcgaaaacgatggcggcgcaaacgggtatgacttcagcgccaagcatctgattgacgcactcgatcacgagcttgaggctttgcagacggattacgtcgacgccgtgctgctgcaccgtattgacacgctgtttgagttgaacgaggtcgccgaagcattcgatgcgttggaatcaagtggcaaagtgcgtcatttcggagtcagcaatatgggcccgtggcagatcgaactattgcaaagcggccttcgtcagaaattggaaatcaaccaactgcagttcggcctgatgcatacacagatgctcgacgctgaaatccaattcaatatggcgagcgatcccgcagccgatcgcaccggtggcatcctgccttattcacggctgaagcatatgaccattcaggcatggtgcccattccaatccggcacggaatacggtccgttcgtcggcaacgagcatttccccgagctgaacgccgaattgacccgtcttgccggcaaatacggttccacgcccaacggcattgccgtcgcttggattctgcgtcatcccgccggtatccagccgttgctcggctcaatgacaccggagcgcatccgccagatggcggccggtgccgatatcgaactcgaacgccgtgactggtggtcgctgtatcaggcagccggcaatccgttggtgtgagcgagagatgacgagaccactgccgttgaggcgcgtgttcagcgtgcatacatctcaacggcagttaatgctgtgtcaatccacccacgacgagaacaacgacacgaacattccgcgaatcacatcagaacgacggcatatcgagcgagggaactgaatcatcggccttactggtcccgttcgcgggcgagccgacatcgtgattgtggaaccactcgacaacccgtgtttcactcatcggcatcaaatcccaagcatccaagccaacattcagtgcctccgggcgtgcaccaccgagtccctcaatctcaaccgtatcgtgcggctccaaactttcgaacaggttaagtgcggggcggtcttccaaccaccagtcgtgaaatacctcatgacagtcgccttcccttttcggcgtgcagcaatcgtttcccatcctaggcgcagccggcacctgtcggttcgtgttgccataatgaggcgcattgcaggggaaccagtgaacgcaagctgccagccatcgtgacggcgaacgggttgagaaaggcgctgtgcctgacccttggaacctgttggccaacaccatcgaagggagcaaacgatgtcttttgacgccgccgcattcggcccgatcaccttgaaccacctgccgccgttcgcccagcgcctacgacatgcagtacacgtggaaacccgaatgggacgtgtgaggcgcacgatggatgagcggtgggcgcgtgctttgcgtgccaagggcattgatattgacgaggctgacggtgctggtgggaaacaggcacacgacggcaaacggcataccgacatcacgggtactggtcgacgccccgagtcccagccggctgccgggctccgcggtcgatccaataccagtacgaatctgccggggccgaaggtgacggcacgcgccacgccattcaaggccaccggtcataagggcggcatcagccggcaggggaattgagctgatcgcagaaccatcgcgcgatgaatgggcgcggccaacgccattccgccattgttgagccgcttctacttggaccggtacctctttgaacggagatatcattccgcaaaaggtcgaatgtacctctttgaacggagatattccatattgaagctattccggcatcatatggtacgtaggaaatcccggatatcggcgatttcctcatcacagatggcatgggccatgccggaatactcgcgataggtcagatgtccggcccgttcaaggacctgatgggccgtttgctggtcgggcagcggaatcgtgcggtcctgcgcgccatacgccaggaagaatcgggtaggggagtcaagcgccgcctgttcctcgcccatgaacgaaggactgagcaggatcgcggcatcgaacaacgtcggatgcaccttgaccagacgatacgacagataaccgccttgggagaaaccgatcaatatcttcctgcgatgggcgaatgccgaggcatccagcagtgaagccaccgcatccccgaccgccgcgcattcgcgttggcgctcgtccacgccgcagccgtcgggataccagtaattgccgcccatatagggcctcgcgtaggtggcgcggaacgagatatagctgggtacggcggcaattgcggccggggccgcatcggctcgcgtcggcgcatatacggcgtcgagaatccgcatcatctcgctttcgtcgttgccgtaaccgtggaacatcaggaaaatggggtcattgccgccggcatcgatctggcttgtcatctgcattcgcatcgtcatcacctcaccagcgagcttacatgcattagacttgtagcgattgacccaccgagcacgcaaggagcaagttatggagccgaggcgcgggcctctcaccgcaggcgagaaagtgcagttcaccgaccgcaagggcaagaagatcaccgatcagcttgtggccggcggctccacgcagaccgagcatggcctgattctgcatgacgatgtgattggcaagaccgaaggcaccgtaatcctcaccgtgcatgccaagcgcgaggcacaggtcaatcaggtctaccccgagaaagacaagaacaagccgtggaaatcgtcgcgcgccatcggcggctgggagtatgcggtgatgcgcccgcgactggccgattatgtgctttcgatgccgcgcggcgcgcagatcatgtatccgaaggacatcgcccaagttattcagctcggcgacatccgctccggcatgcgcgtgcttgagtccggtgccggctcgggcgcgatgagcgtgaacctgctggacgccgtgggcgagcgcggccacctgaccacgatcgagctgcgccccgaattcgccaaggtcgcccaagccaatgccacgctgtactatggcgaggcccccagctggtgggatctcaaaaccggcgacttcgattccgttgccgccgaactgcccgaacactggttcgaccgcatcatgctcgacatgctcgacccgtggaacaggctcgagcaggcataccgcgtgattgcccccggcggcgtgttggtcagttacgtaactaccaccacgcagatgagccgcatggccgaagccctgcgcgcggccggctgctggaccgagccgcagatccaggaatcgttcgaacgcacatggaaggcccagggcctcgccgtacgccccgaccaccagatgatcggtcataccggtttccttgttatctcgcgcgccatggcctccgggttcgaggcgctcagaaagcgcgatcgcgtgaccaaggacacacagaccgacatcgactcgctcaccgacgaacagcgtgaagcgcagatcgaggaactggaactgcgcgacatctccgaccacaaactacgtaaggtgttgcgcgacctcgaccgtcaggtgggagaacttggcaatacgcacgaataaccgccaaacgatgagtttgtgaacgctcacacacctctatactggaagcaataccacaccgccacaccgccacaccgggcagacggttcgtgaagggagccacggatgggcatcaagctgagtaaagtcgccaaagcggcgaagaaatacgaccatattctcatcatcatgaggcatgccaaggctgagccgttcggcgacaagggtgactcggagcgcgagctcaccgacaaaggtctgaaacaggcgaaggccgtgggcaagggcatcgagtcgttgggactggtgcccgaccaaatctcctgctcgtccgttacccgcacgcgccagacgttggaccgcatgctcaagacctttggcgacaagccaatcgtcgactaccgcatcagcctgtatgacgggggagtgcaggcggtgttcgacgagctcgcccacgtcaaggccaagaatcgcgtgttcatgatcgtgggccacgagccgactgtgtcgatcagcgcccaatggctcgcctccgccgactccgacggcgaacgactcgacctgctgaatttgggactttcgcccgcatccatcgtgatcatgggatcgaacaaaccgttcgacgaatggcaggtgcacagcggcgaactgctcgcggtcatcaatgtgaaagacttcgactaaagcggatataaattccatctataacgacactctgcggccatttataagggccggaatccggatgttttgctaccctaagtcgggttacgaacgcatacattggaggattcatgtccactctgacttccgtctccggcttcccccgcatcgggcagaaccgcgaactgaagaagatcatcgaaggctactggaagggtgccaacgacctcgccgccgtcaaggccaccgccgccgaactgcgcgccaagcactggaagctgcagcaggccgccggcatcgacctcattcccagcaacgacttcagctactacgatcagatgctggacaccgccatccttctcaacgtgattccgcagcgttacgcacgtctctccttcgacaaccaggaggacacgctcttcgccatggcccgcggctaccagggcgacaagggcgacgtgaccgccctgccgatgaagaagtggttcaccaccaactaccactatctggtgcccgaagtcgagtcggccgcggagatcaagctcaactccaccaagccgttcgacgagttcaacgaggccaaggcgctgggcatcgacaccaagcccgtgttcatcggcccgtacacgttcctgaagctcgcccgtaccccggaagccaccgaactcgagctcgacaagggcctggtcaacgccgtggccgccgtctacgtcgaagtgctcgccaagttcaacgagctcggcgccgcatgggtccagctcgacgagccgtacctcgtgctcgacaaggagccgggcgacgttgaactcttcaagaccctgtacaccaagatcctgtccgccaagggcaatgtcaaggtgctgctcaacacctacttcggccacatcgccgacgtgtacgagaccgtcaacctgctcggcttcgacggcatcggcctggacctcaacgaaggtcgcgaggagaacctcgaagccgtcgccaagtatggcgtggcctccaacaccaccatcttcgccggcgtgatcaacggccgcaacatctggcgcaacaactacgccacctccctcggcctggtcgacgccctgaagcaggtcaccgccaacgtggccgtctccaccgcatcctccctgctgcacgtgccgttcagcaccgaaggcgagaccggcatcccggccgaagacctcaagcacttcgcgttcgccgtccagaagctcgacgagctcaaggaagtcgccgccctggccgacgccaccgaggacgagaagaaggcatccgccgccctcgccgccaaccaggctctgttcgacggcacccgcgtggccgccgacccggccgtcgccgagcgcatcggcaagctgtccgacgccgactacgtgcgtcagcctgcccgcgaggagcgtcaggccctgcagcgcgaggccctcggcctgccgctgctgccgaccaccaccatcggctccttcccccagaccaaggagattcgcgccgagcgtgccaagctgcgcaagggcgaggtcaccaaggaagcctacgacgagttcatcaaagcccagatcgacgccgtcatcaagaagcaggaggagatcggcctcgacgtgctggtccacggcgagttcgagcgtaacgacatggtcgaatatttcggccagaacctcaacggcttcctgttcaccaagaacgcttgggtccagtcctacggcacccgttgcgtcaagcccccgatcgtctggggcgacgtttcccgcgccaacccgattaccgtggaatggtccgcgtacgcccagtccaagaccgaccatgtgatgaagggcatgctcaccggcccggtgaccatcctcaactggtcctggccgcgcgaggacatcacccacgaggagcagaccaagcagctcgccctcgccatccgcgacgaagtgctcgatctcgaggccgccggtatcaaggtcatccagatcgatgaggccgccctgcgtgagaagctgccgctgcgcaagtccgactggcacgtcaagtacctcgactgggccgttccggccttccgtctggtgcactccgccgtcaagccgaccacccagatccacacccacatgtgctactccgagttcaacgacatcatccgcgacatcgacgcgatggatgccgacgtgatctccttcgaagcctcccgtggcgatctggtggtgctcgacgccattcatgacgcgcacttcgagaccgaggccggcccgggcgtctacgacattcactccccgcgtattccttccgagaaggagatcgaggatcgtatctacgagatccttgacaagatggacgtcaagaaggtgtggatcaaccctgactgcggtctgaagacccgtggtaacgccgagacctggccgagcctggagaacctggtcgccgccgccaaggccgtgcgcgccaagctcgacaagtagcggaaatcaccgagctccctctggatgagggagctcgggtttatgtaaggaaatcagcatgcattccccgatgttcacccttgaggtctttcccccgaagcgcaacgcgcctgtcggcaccatctacgacaccctcgacggactcgaagggctgaaccccgacttcatctccgtgacctacggtcacggcacccattccgaccgcaccgccaccgcgcgcatcgcccacacgatcagcaaggaatacggcatccctgcagtcgcccacctgaccgcgctctactccgacaaggccaagatcgatgaggctctcgacatgttcgaggaagccggcgtgagcgccgtgctcgcgctgcgcggcgactacatcgacggcgagcagctggtcggcgagttcaaccacgccagcgacctcgtgtcatacatccgctccgtgaagccggacttcaaggtgtttggtgcttgctacccggaaggccactatcaggctgactcgctggaccaggacatcgaaaacctcaaaatcaaggttgatgccggcgtcactcacctgatttcccagctcttctacgacaatgaggacttctaccgcttcctcgacaaggcgcgcgccgccggcatcaccgtgccgatcgaggcgggcatcatgccggtgcgtggagccaagtccgtgcgtcgcatggccgagcgcaacgcctcgcgcatcccggacaggctcaacaccctgctgaacaagtggggggacgacatccagtccctgcgtgccgccggcatcctctacgcttccgagcagatcgccgacctcgtggcccacgacgtggacggcgtccacctgtattcgatgaaccaccccgccaccacgcgccgtatctggcgcaatgcggaaccgttgttccgcggtacgcaaggttgacgcatatcgcggcgcggcgcatctcaatgcgtcgcgccgcacgttaatctgctggcgaaacccagagttctcccagcggccgatgggtatcatgaacgtgcaagccaaccaaagcgatggaagggagtccgttatgtgcactggtgtccgtttctccgatgatgagggcaacacctatttcggacgtaatctcgactggagtttctcatatggggagaccatcctggttactccgcgcggctaccactatgacacggtgtttggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgtcagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccctgccatccgttcctacgccatggccgattacgatatggattcctcggagctcatcagcgtcgcccgatgactccttcccggctcatgccccattcggagggcatgagcgtatatagtggaatcttatggaatcgtcgatcttcaaacccagctccatggacctcatcagggcaggtctgcaagacctcgacaaggcccgcgccttgttcgaccagctcaaggcggacgacattcccgatgagcgatgcgccgaactgctgagcgcgctggcccacgcctgcgaccccgatatggcattgagcaatttcgtggatatcgtcaacgcgatgcaatccagccagcgcgatctggaacacgtcatccccgacaacgacgccctgaagcgtctggtcacggtgctcggcgtctccgacgcgatgggcaagttcatgcgcttcaagccgcagcttgtggaggcggcagcagtcgacaactgcaacagccatctgttcaatcacgcgcaacgccgtgcacgtctgctcaaggcggtcggcgcggacccggacgaaccggccatgcccgtcgcctccaaggatctggccgaagcggccacggccctgcgttccagctaccggaaccaactggccgccatcatcgcccaggatgccgtggcggacgacccgacctccatccaaccgaccatcagccgcgaactgtccgacctcgcggacgcggcgctcgaaggcgcgctggccatcgcccgccacgaaaccgagggcagcgagcacgtgcgcttcaccatcatcggcatgggcaaactcggcgcacaggaactgaactacgtctccgacgtggacctcatctacgtggtcgaaccggccgacaaggatgtggaccatcagacgctgattcgcgtgggcaccaagatgggcaccatgttacagcgcgtctgccagtccgccatcatgggcgtggccgagcagccgctgtggcagatcgacggcggcctgcgcccggaaggcaaggacggcgcgctggtgcgcgtgctctcctcgcacaagaactattacgagcagtgggccgagaattgggagttccaagcgctgctcaaggcccgcccggtggccggcgaccccgacctcggtcaggcctacatggacatgacccggccgttcgtgtggagcgcatccaagcgcaagaacttcgtctacgactgccagaaaatgcgcaagcgcgtggaggatttgattcccgcgcccctgaaggaccgcgagattaagctcggccgcggcggtctgcgcgatgtggaattcaccgtgcagatgctccagctcgtacacggccgcaccgacgaatcgctgcgcaccagcaacacgctcgactcgctgcagcgcctgtccgaaggcggctatgtctcgcgcaagcaggccgtgcgcatgtcccaggactaccgcttcgagcgcgtgatggaacatcgccagcagatctggtccctgaagcgcacgcacctgttcccggacctcggccgggcctcggtcggaggcctcgaaaagaagcgcgacatcgacgtggacgagctcaaccagaaccaggagctgcgccgactcgcccgcgcattcggcctgcacccggaagaactcgtcgacaagtacgacgacacccgccgcgaagtacgccacctgcacctcgacatctactatcgcccgatgctgccggtcaacgcccagatggagaacgaccagatcgtcctgagcgtcgaggcagcacaggaacgattcgaatccatcggtttcggcgacccggacgccgccatccgccacgtgcaggcgctcaccgccggcgtggggcgcgcggccaaaatcaaccgcatcattctgcccgccgtcttgcagtggctgggcgagggccagaacccggacatgggcctgctcaactggcgcaaactggaggagaacttcggcaccgaatccggctacctcggcttcctgcgcgactccacctccgccgcccagcgcctgtgccacatcctgtccaactcacgattcctgggcgacgcgctcaacaagtcggtcgaatcgatcagctggcttggcgacgacgacaatctgcaggcccgcacgcgcgaggccttggacgtgcagaccggttcggcgctggaacgtttcggctcgaacatcaacgagttcgccacctccatgcgcgccatgcgccgccacgaaatcgaacgcatcggcctgtcttggatgagcggtgtgatcagcgactccgacagtctcaaggccatgaccgacgtgtatgacgcgatcatcgatgcctccctgacctgggccgtgcgccaccagatcgccgagttcggcgtcgaaaccgcgccggccggcatcaccgtcatcgccatgggccgttacggcgggcgcgaagtgaacttcagctccgatgcggatgccattctcatctaccgtccggccgacgatgccgacgacggccaagccaacgccttcgccaagaaggtcgtggaagacctgcgcaacatcctgcaaggaccgacgacgctggaacccaagatcgaactcgacctggacctgcgcccggaaggcaagaacggcccgctcgtgcgctcctatgcctcctgcgaggaatactacgaatcctgggcttcgacctgggagcgccaggcgctgctgcgcgcccggtacgcggccggcgacgctgaactggcgcgggacttcctgatcaacatcgccgatccgctgcgctacccgaccacggaactgactgaagcagaattgcagaacatccgcaagctcaaggcccgcatggaagccgagcgtctgccgcgcggcgtgcgccgtgaacggcatctgaagctcggcaagggcggcttgtctgacgtggaatggaccgtgcaactcatgcagctccagcacgccggcgatatcaaagatctgcgcgtcaacggcacgctggaggcattggacgtgctggaagccaagaagctcatcagcgctatcgacgcgattcagctgcgcaaggcatggacgttgtgcaccgcggcccgcaacggcagctatctgtggagcgggcgcgccaaccaggccgatattctgcctgatgacatctattcgctgggcggcatcgccgtctacctcggctacggcgcccaccgcggccagcatttcgagaacgacctgctggccgtgatgcgcaaatgccgtgacgtatgccagcgcttgttctatgggaagaccgaaggcgaggcggctgcggcaaccaccgccacggcctccgccgcaacgcagcagccgcaaaccgcccctcgcccgcgtatgcacgtgatcgcaccgcgactggaacgaaatcgacgccgcgcgcagcgataaggcagcatattcgttggattttcaggtggacactcggtgaatgcggctgtccgaaaaatggcgtaagttagattaggtcacgcaagggtggccacctgaaaaccacgagcgaaaaggtgagccttgtctgaagaaacgccaatggtcggcaaaagcgtcgtaacgctggacggcctgtctacaaaccagattctcgacctgctgcataaggccgaatacatcgattcccaccgcaaagagattgcccatacctgcgatgggcgagtgctggccacgctgttctacgagccctccacccgtacgcgcctgagctttgagaccgcaatgctacgtctcggcggcaaggtcatcggattcgccggcgcgcagctggcctccgtgaccaagggcgaatccatcgccgacacgttgaagaccgtgtccaactacgtggacgtggtcgccatccgtcacccgaaggagggtgccgcgctggtggcctcccgcgccgcatccgtgccggtaatcaacgccggcgacggcggccacatgcaccccacgcagacgctggccgacctggccacgctgcagtcgcgcttcggccgcatcaccgacctgaccgtgggactgtgcggcgatttgaccttcggccgcaccgtgcactccctgatcgagaccctgtgccgcttcggcaacgtgcgcttcgtgctcatcagcccggacgagctcaagaccccgcagtacgtgatcgaccgcatcaacgccaccgacagctgctcctacgtggaagtgcgcgacctggcctccgtgatcggcgacctcgacgtgctgtacatgacccgcgtacagaaggaacgcttcttcaacgaagacgactacctgcgcctgcgcgacacctacattctcgacgaagagaagctgcagctcgccaagccgtccatggccgtgcttcacccgctgccgcgcgtcaacgaaatcgccgtggacgtggacgacgacccgcgtgccgcctacttcgaacaggtcaagaacggcatgctcgtgcgcatggccctcgaaagcaccgtggtgggcgacgaactgcccggatacgaaccgctcaaccccaaggaggttcaggcctgatggaagtcaccagcattcagaacggcatcattatcgaccatgtgccggccggaacctcgctgaaggttctcgaatacctgaaaatcgacccggccaaaaccaagcttgcgctcatcatgaacgccgactccaagcgttacggctccaaggacatcatcaaaatcgaagatgacaaggacatcgacctcgacgtgctcggcttcgtggcccgccaagccaccgtggacgtggtgcgcggcggcaagatcgtcgaaaagaagcagccgaacctgcccgagcacatcgtcggcgtgatttcctgcgtgaacccgcgctgcgtgaccaccgccgagcccggcatcaagcagatgttccacctcgtgcactccgagcggctcgaataccgctgcgactactgcgacgaggaagccaaactgtgagcatcaccctacgcaacatcaaggtctggaacaccggcgaggtcatcgacctcgtggtgcccgggaccgctgccgcctacttcgccgacacctccgccgtggctgacggcgccgacatcgacgccaccggcctgaccgtggcccccggtttcgaagacccacacgtccacttccgcgatcccggccagacctacaaggaatcgatggtctccggctgccgtgcgtccgcatccggcggatacacgaacgtgctcatcatgccgaacacgttgccggcactggatgggcagaccgtgtctggcccggaagcgaccggtgcaaaagaggttctggatgccggcttcgacaacgtcatcgacttcctgcagcagtacgatactgcgcatgacgttcaattgccggttcgttacgatctgtgcgtgtgcgcgtccaaggatcgcgccggtcatgaggcaagcgacgttgccgattggctcaagtacgtgcccggattcgaggacgacgccaagacgccggccatgctcacgcaccccatcaccgcaatcagcgacgacggttccgctgtgacgccggagatcctggaccaggtgctggagaacgtcaaggcctccgacctgtacctgatcgagcattgcgagcatcacgatacaggtgccgtgaacgaaggccccgtttcccgcgagcttggcgtgcccggcattccggaagacaccgagctcaagatcgtggcccgcgatatcgaagcggcccgccgcaccggtgtccacgtgcacttccagcatgtgagcactgccatctcgttcgaggcgattcgcagggccaaggccgaaggactgccgattacctgcgagaccgcgccgcactatctggcgttgagcgacgaggcgctgctcaagtacggcacgctcgccaagatgaatccgccactgcgctccgaagcggaccgcaaagccaccatcgcggccatcgccgacggcaccgtggatctgctggccaccgaccatgcgccgcacacgttggcagagaaggaactcggcttccttgaggcgcccaacggcatcatcggactggaatgcgcgtacggcgtgtgccacaaggtgctcgtcgacggcggcttcatttccgatgagcgtctgatcgagctcatgtccgttggacctgccgaactcatggggcatgtgccaaccgacgtagccgcgctggtcgaggactacgccgaacccgcgcccaccggggatgatccggatggcgtgattgcgggggagagcgacgctcagccgcagcgtgaaggcgtcaaccgactgctcgacttgagccgcgtggatgacgccgacaatgtcgacctcgtggtgctcaacgccgccgaggaatggaccgtggaccccgaacagttccactccaaggctcgtaacaccccgttcggcggctggcaggtcaccggacgccccctcgccacaatcatcggctcccagctgatgttcagccgtctgtagataacacaaggagcagcatggatcgcctgatcgaagcgattgacaacactcagaaccccagcgtcgtgggccttgaccccactgaggcgctggtgccgccgcaggtcgtggcgagctttgccgacgaggtgcgtgactcggtcgaatccccggaggaagtcgaatccgcgcagctggccgtcgcctacttcgaatacaaccgcacgatcattgacgccatcgccgacatcgtgcccgccgtcaaaccgcagatcgccatgtacgaggcgctcggccccgccggcgtggacatctacacgatgacctgcgaatacgcggcccagcagggcctctacgtgctcggcgacatcaagcgtggcgacatcggctccaccgcagccgcctacgcccaccacctgaacggcgtgggcgacttcgacccgtggcatgaggatgcggtgaccgtcaacccgtatctcggcaccgacggcatcaccccgttcgtcgaggccgccgccgaagccgacaaggacatcttcgtgctcgtgcgcacctccaacccgtcctccagcgaactgcagatgctcgacctggccgacggcacgaaggtctacgagcacgtggccgatcttgtggaaggatggggcgccgagaccatcggcagccacggctactcccgcgtgggcgcggtggtcggcgccacccaccccgaggaaggcaaggcgttgcgtgaacgtatgccgcacacgttcttcctcgtgccgggctacggtgcgcagggcggcacggccgcggacgtggcaggcatgttcgacaagcagggcagcggcgccatcgtcaactcgtcgcgcggcattatcggcgcatggaagaagagcggcaagtactccgaatccatgaccgccgacgaggcgctggaccttgtggcgagcagcgcgcgccaggcggcgctcgacatgcgcgataatctgcgggttgccgtatataggtaggtagattgtccggctgtgggctatacgtgagtgtgggctggaaaccggagccgagtgtgtttaactacctctcagtcaacctgcggttgaccgctcccctgatagggggagcttgatgtgctgaataggaatgaaatgacaactttcacccccacccatgatgtggttacggaagcgactgcggccggattcttcccgccgcgccacaacgtcgaaatcacgcaggttacggaactgaccgaccgcgtgatgcgactgacgttccgcgacccgttcatcgcctcccatgccaagcccgcccagttcgtcaacctgttcacgcacgacgacttcatgctcatgccgcgtccgttcggcgtcagcgaagtcgacggcgacgaagtcagcgtgatcttcgccgtcgtgggacacggcaccgaacagttggcaggactgcaggccggcgacaccgtcgacgtgctcggcccgctcggccgcggcttcaacctcaaggaagacgccaactacattcttgtcggcggcggactcggcgtgcccccgctaatctacgccgcgcaaaagctcgccgaacacgacgcctcctttgccaccgccgtattcggttaccgcaacgaccacttcgccgaggaatacgtctcccggtacgcggactggtcgtggagcatcgacgacgccgaaggcaacgtggtcgacctgctcaacaaactggaacaaggcgacgacctgaaggcctacgatcgcaagccgatcattctgtcctgcggaccgctgcctatgatgaaggccgtggccgactgggccgccgaacgcggcatccccgcgcagctgagcatggaacagcgcatgggctgcggctatggcacctgcgtgctgtgcaccatcgacaccgtggacggccgcctcaaggtctgctccgacggacccgtgttcacccgcgaacagctcggatgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaaggaacatcatggcagaaacactcgcacatcgcttcactgaattcctgttggaatccaacgcgctgaagttcggcgacttcacgctgaagtccggccgcaagagcccgtacttcatcaacgccggcgccttcgacgacggcaagaagatcgccgcgctcggcgcgttctacgccgaaaagattagccaggccatcgtgcacaacacgattccccgcaacatcgacaccgtgttcggccccgcctacaagggcattccgctggccgtgtccaccgcgatcgcgctgaccgccggccacaacatgaccgtcggatacaccttcgaccgcaaggagaagaaggaccacggcgacggcggctggatggttggcaccccgctgaccgacggcatgaaggtgctgctcgtggacgacgtgatgaccgccggcaccgccgtgcgcgaagtcatccccaaactcaaggccgaggcgaacgtcgaggtcgtgggtctcgtgctctccgtggaccgcatggagaagaccaaggactccgacatgtccgccgtgaaggccgtggaagccgaattcggcttcccggtgctctccatcgccaacgtgcgcgagatcttcgacgccgccgccaagatgaagaaccccgacggcaccccgctgctcagccacgacatccagcagcgcgccgccgcctaccttgaggaatacggcgcctgatcgtcttcaatctaaaaaccaaaagcgggcttgcgagcccgctttttttattacgttccatgaacagcagcaccatattaaggcaaaagctttggcaaggagcgtgctatgaactggttagttgatatagggctgtttgcgctcgtggggatatgcagttacttcggcatcgagcatcatctggacagcaaagcgaacaagttgtcgcaaggtaatgaagaagaccgccgagatgctgatgcccaagtagaagcagcatgaaaatggcggaatgacgttggggtgacgccgctcatactcgggatatgacggatgaacagcctcttgaaacggagataaatgtctccagaaggccaaatcagctcccttgaaagcgagatagggttctaaactctgggaccgactcgcctgtgatgaaaacccgctcggcgtagaattaccgtaggttcgttgcattcgaacaaggaaggccgctatggggaacatcaccgacgatattcggcaacatttcgacactttcgccgaactgccgttcaccgaggcggatagcctcgctttgtcccagttggcctatgctcgcatgccggataacgtgccgcgctatcacgagaatgcagagaccgccgacggcatgatcgccacggttccgattcacgatttgctgcgtgccgaatgctatgacgacatgttcggcaaggtgtggtcgccttcgatgaatgtcgatctgttacgtgcgatgagcgagagcccacgttggaggaacctacgcgtgggcgcatacgtggacgaattcgatgctgcaaccaccaagcagttctcggcctgcgtgttcgaactgggtaacggcacgctctatgtggcttttcgcggtaccgacagctcaatcgtcgggtggaaagaggacttcatgatggcgttccgccgcccggtcgcctcgcaggaggccgccgcgcgttatctgaccgagctggctggccattgggccgggccgattatggtcggcggccattccaaaggcggcaatctggcggtgtatgcggcggccaatgtgcctagcgagattcaggaacgtatcacggtcgtatattcgcacgatgggcctggattcgatgaggcgttcttcgatgaggacgggtacgtacgcattgcgtcgaagattcataaatcggtaccgggctcgtcgatcatcggcatgctgtttgagactcgtgagcatgtggaagacggctatacggtggtcagcagcgacggtgccagcatcatgcagcatttcgcattgcactggcaagtcgatcatagccaattcgtacaggctgatggactgacaagtagcgcgcaatacctggcacgcacgatcaacggatggatggcaaaatacgacgacgagcatcgccgcaagttcatcgaaaacctgtttgccatcttcgaggctggcggatacgacacattcggcgacctcacttcgcatttgacacagtcactgccgattatgctcgccgcggcccgcaacattgatgtcgaagatcgcgacgtgatgattgaagtgctcaaaggcttcgccgcgacagccgccgcgtcggtaatcttggccaagtagtcggaggccatcaaactggttttgccagtcagtctcaatagcgcaaaagccggcccctgagatactcaggagccggcccttacttccatttccccagcggggttggcttaatcgcagtatatctcactgctgaccatgcctgttttacttactcctaatcaatgagcttgtagccgtggtcggagactacggacttgagcttgtcgagataggtttcggcggccttggagagcttggaacgctcgttcgtgatccagccgaccaacatcgtttcgtcggtgtcgagcggcacggtgacgatcttctcgttgttgaggtcgccgttgtcgatgccggtgcacaccgtgtagccgttgaggccgatgatgaagttcaggatcgtggcgcggtcggtcacgttgatctgcttgggggagtactccggccagaccgcttcctcatagaagtagaacgagccttcctcgccctgctcgtactggatgaacggataaggtttcaggtcctccatggtgatgaccttcttggcggccagcgggttgttgcgcgagatgaacacgtgcagcggcgcgcggaagagcgggtggaattcgaggtgcttctcgcgcaggagcttgccgatcacgtccttgttaaaatcggacaggtagatgatgccgatttcggactgcatgttggcgacctggttgatgatgccgcgcgtgcgggtctcgcggatggtgaactcgtattcgtcggacttgatggagttgatcatctccacgaacgcctcgacggcgaacatgtagtgctgggtggagacctggcacagctgcttgcgcggtttggcatgcttatagcgctcttcgagcaggtcggcctggtcgagcacttggcgggcgtaggtcaggaattccgcgccgtccacggtcagggcgatgccctgcgaggagcgggtgaagatctcgatgcccagctcgttctccaattccttgaccgacgagctcagggccggctgggagacgtacagggcatgggaggcctcgttcatcgagccgcactcgacgattttgacgatgtatttcagctgcagcagtgtcataaagtctatttatatcgctagggatagtcgccacacggccggtcaccgtcgtcaaggacgggtccatagacttcaactgccgcgatgcaacgtttggcgacttacagacgtacgccgagttctgcgagcgattcgcgtgcctgcaacgcgttctcgaagaggatgccgtggatgccgacctcgttggcgccgacgatgttcttggcggtgtcgtcgaagaacacgcagcgctcggccgtgaggccgaaacgggtcagggccagctcgtagatgtcggcgttcggcttatgcatcttctccacgccggagaccacggtgccctgcaacagctgttcaaggcgcgggtacttctcgaaggccaggtggaaggtctcatgcgaccagttggtcagaccccatacgccgtagccgtgggccttcaaatccgccagcagctcgaccatgcccggaagcgtgcggggcagcgcgtccgcgtagtggccgatgtagaacttgaagatgtcggcgagttcctggccttgttcgcgtaccacatccgggtagatgtccgcgaaatcctcgccggtgtccatgcggtcctcgtagcggaagaagccgcaggggtcgtcgtcggcgcagatgcgttccacgatctcatcggggaatcggccttccaggcatgcgcgggtgttccagtccagcagcacgccgcagaagtcgaaaatcacgtcggtgatgggggagttggccatgatgctccttgtgttgttggggccgttgagtggggtctgcgatttagtatagggggtttcatacgttggctcccctctctgaggggagccaacgtacggaatcatgcgatgacgtcggcgatggcttcggggatggcgtgggccacgtcgccggccacaatcgggtggccgagcgtcatgaagcgctggcgatgctcgcggccgatcagttccggctcctgccagccttgttgctcggattcggaggcgatcgccgccgccaggccatgcaggtaggcggccgaggccacggtctcgcccgtggtggccacgtcatcctgctgggcgagcagggcgccggtcagaccggccagcacgtcgcccgcgccggcggtgcccagccaggccggtgcgctacccgacgcatagacgtggtcctcatccaccacgatggtcaccgcgcccttcagcaatacggtggcgccggtgagctcgtgggcacgcttcgcgctggccaacgggttcaaccgcacgtcgtcggcggtgtacggctcgtgcgaatcggcatgctccgcagtgctggcggcggtttcgaaccggttgagcagtttcgccatctcgccggcatgtggcgtgatcaccacctggccgggcacacgctccggcagcaggtcgagtgcgccggcatccaccacgattggcggcatgtcgtaggcgtccttgttctcatcctcgctgccgagcgcgtaatgcttgagcaatgcggcgatggtgtcccgctgcatatcgccgtcggtgccctcgacgctagcctcgggcacgccggaccccacgacccaggactgcacatgtcccttgccgatcacggcttccggcagtgcggcgagcaccatgttctgcgcgcgctccgggcccagataccggaccatgccggtgttcgcgcgggcggcggcgctggcggtgagcacggcggcaccggggtagcgctgcgagccggtcaccagaccaaccacgccccgggagtatttggaatcctcgaccctggggagacggaccgcgtcggacgcgaacgaattatccaccacctcgacgtccggatctttgtcgtcgatatcgaatccgaaatcgagcaactcgatacggccgcaggcgaacgtggcgggcggcagcaccgcgcacggcttcatcgcgccgaacgtgaccgtgaccgtggccggaatgtacgggccgggcagagaaccatcgttcacaccgacgccggatggcgtatccacggcaagtaccagcggaaaatcgcctgacgactcacggtttggcagggcgggctcatcgggagcctcgccgtcgagaccaagggcggaggcgagtgcggcggggatgccgcgtagcgagccttggatgccgatgccggtcatcgcgtcgatgatcagatgcgatttcctggccacggcgatggcggtctgcaatcgctcgccggcctcaccggcggaaaacccggacgcgcaaccgggaatatcagccgcgggatcaagcaccagcaccttgcctccggcgcgcacgaatgaggcgaatccggcctcatgcaacgaccggcccacggcgatggcggtgacgttcgcgccctcctgggccagcgcggcggccgcgaacagaccatcgccaccattgtctccggccccggccagcagcacgatcgacgtgtcctccagcgccagatcctcgtcgtccagcataccggccgccatgtgggccgcggcctgggcggccatgcgcatcagcggcacgcctttgtccagcaggggtcgctccatggcccggaccgtatcggagtcataggcgctgtgcagcagcagttcgcgacgatcggcgtcttcggtgtattccatggcaacccctttcttgtgtttgttacttgcggtccgtgtttacaggccgtacacctcgtgggcgaacttttcgaacacggggatcgagcgcttgaccttctccgtgtcgatgcagtaggccatgcggaagtatccgggcacgccgaagctgtcggacggcacaagaatcaggtcgtattccttggccttcatgcagaacgccacggcgtcgtcctccagcgccttggggaagatgtagaacgtgccgccggggcgcaccacgtcgaagccgatgccggtgagcgcatcgtagagcaggttcatgttcgtctcgtagacgttgaggtcggcggtctggtcgatgactttggctacgcccagctggatcgagctcggcgggcagttgtggccggtgccgcgcgagatttggcccatcatcggcacgagcaggtcggcgtcggtggctgcggggttcaccgcgacgtagccgatgcgttcgcccggcaggctcagcgacttcgaccacgagtagcaggtcagcgagttcgcatagaagctggccgggtagggctgggtggctccgtcgaacacgatttcgcggtaaggttcgtcgctgatcaggaagatgtcgtggccgtactcggcctgcttggcggtcaggatcgcggccagacgcttgagcgtgtccgccgaatacaccgcgccggacgggttgttcggggtgttgataagcacgacctgcacgttcgggttaagcgcagcctcgaacgcctcgaagttgatctggaagttctcggtgtcggccggcacgatggtcagcttggcgccggtgcccttgacgtacggctggtattcggggaagtagggggcgaaggtgatgatctcgtcgcccggcttggtcaccgcacgcatcgcgtgggacagcgcgcccgccgcgcccgtggtcgggaagatgtggttgccggtgtatgccatgccgaaacgttcgttgaggttttcggcgatcgcgtccttgacggatgggataccgagcgaaggggagtagccgtggatggccaccggatcgccgttttcgtagaggtcgaccatggcgtcggtgaaggatttcggagccggcaccgagggattgccaaggctgtaatcgaacacgttctggtagccgatttcggcaccgcggctcgtggcgtactcgctcagttcgcgaatcacggacttgccgccaagcatggccttgtattcctcattgatcatggctgttctcctcgcatggttgtactggtatgcaccacgctactactatcgcggccggtttgcgccatttgccgcgccgtgcctaagctggctgttctatttgttctatttgttctattaactgtcgaaaccgcggaataacgccgatttccgctacagctccatgattatccacaaccgttcatagcgagcgctgtgggacggcgggcggaaaacggccgaatccgcgtgccgtcccacacctcgtgcaatccacgtttcgggaaagcaccaccgtaagaccggcgcgcatccgcatccacgacaggagccttaccggccgtaatcccgcactcgattattttttctgacagggaatcgaacccgaaacactaacccatgcacgccccaccgcaaacagcgaataaccaaatgtatgcattttcggcaccatgagcgaaggagttcgcaaacacaacagtgattggcatatacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctctgcggtgccagcaatttccggttcggtggacctcgatagcaccttgacgacggcgtgaagtgcgtcaagccgcttgtgattgatggtgtataaccatcaacgagatgctgcttcagaactgagttggcccatcgccggaaattagatgccttccttggatttgacgcggtatccgaccgacaggatcatatccaagttgtaatgctcgacttggtatgtcttaccgtcagatgcagttgtcgcaaattctgtgacaactgaaaatccattgagctcttccctcaatgcattgccgacatgcttgccgattgttttgatatcgcggccaaacagcaaggccaattgctgtctgttaagccacaccgtgtcctcgtctaccttcacatcgaggtgcacggtgtggtccgcgctctcatacaaagcaatctgccgcttcagttcctcgccagtcatgagatcgcctttcttttttcgggcgtctgtaaatcatgtcgttgtcgtcgctaaattatgcatccagtttatcagggcagtcgaacgtttgttcgattactgtatctctcatatttgtatgactttcccggctcccgccatcgatcaccagtcgcagataatcgcggtcggcggacttgcggcgcggcacgaaacgactgatgatggagtccttcttgccgcggttcttcacgtacaggaaaccgaacacggagaacacgaccgcgccgatgaagttgacgaccagatcctccatcgtgtcgatcagaccgatgtcgaggtagccgccgaggcccaggtcttggccattgaccgtgacctgggtaatgtcgttgatgcgaatcgcatggttggtgtgcgtggggtcgagcatcaccgagctgatggaatgcacgatggcgtccttctgcatgtcgaacccgaacaactggtccatgccgaattcgaagaactcccagatcacgccgatggtcatggagaagcagaaggacacgatcgccagatacaggggcgaaagctcgaacttcacccggtcggaccggttgagcaggtcgaccagcgagaagccgatcgccgcagcgaggaagccgttcatcgtatgcaacaccgtgtcccagaacgggaagatctcatagaacgaactgatctcgccaagaatctcagccgagaacacgaacaccagcacgatgacttccagcaccgaaggcagctcgatgcggaactgcacctggatgaacgccggcgccaacagcagcagcaacgtcaggatgcacaggaacacattttcgtagtcgccgttaaagaactggagtattgccatggcgagcaccagcatgcgcagcaccacatagaccgcgaatgagcttttgtgttcgcggatttccatgcccacggctcggctcatggttttccagcgtacgcgccaggacggtttgcgttgtgcgtcgtgctgttgcgactgtttccgggtcatccttacctctttctcgcattgttctcgcgccagtctatccgaacctgctcacaggcaatcggcaagaacgggcgatagtctggccgcacgaaccgaacggaaaccgatactgtctcgattgtgggccacgcgaatcatccgacaatgctcgatgaggccattacgccggctcctcatggctactggtcgtagggctggcaatcatggccatgccggtagtttgggctatcgtgaggtgtgcgagatgggctttgtgccggctggcagcaaatccaagcagcgaaacaacggaatgaacgaagcgaaaggaacggtatctgatgactccgattgaattgtcaacccgacgccgggttacgggactgacttcggatgagttcgccaggctgttcgtctctttgcagcgtgaagtggacggcgaagccgcgcattggagcgccacggatgtcgaatcctgggagctggtcggcccgccggtgaccgccgaacagcatctcatcgacacgttcgccgcggccaacgaattcgtggccacgcttgcggaccgcctgtaccacacgattatgccagtcacggaagaatcggtcatcaccgcatacgctgatgacctcacattctgggcatcgcatccggaccttggcggagtgccgtgcgcattatggaacatcgccgcactgcaggcggccgaatgggcccgcaaggaaaccggcatcgcctgtgaactggacgtgcgcgaaccgctggtgtgacagctgagctcaaacatgcgtaggtaacggcatggtttgaggactatggtgttgcgttatcggtcggaaaggatgtgatggtggggcgtcatagcaaaaaagcgcgtggccagtcgaggagatatgcgcgaaagccctccgtttggagcgaaattcgcggctatctgctgacagtgatcgcggtgatgctggtcgtgttgctgggacgtaccttcgtgttcaacgtatatgtgattccatcccgcagcatggaagacacgttgcaaatcggcgaccgcgtatttgcctcgcgattgactccgagactctttacactgcaccgtggcgacatcatcgtgttcaaagatcccgcagactggatggagggggagcagcttcccaccaatctgatgtcgataatcgacagcaatcgttacctaatcaaacgtgtcatcggtctgcccggcgataccgtcgcctgcaagggatccggggagcccatcacggtcaacggcaaacccattgatgaaagcgcttatcttaagtccggcgtgaatccaagcgacagccctttttccgtaaccgttactgacggcaacgtgttcgtgcttggtgataatcgctccaattccagagattctcgataccatcttgacgacggcaacaatgggctagtgccatacgacgatatccaaggtgtggcgttgttccgcttctggccatttacgagaatcggcatactgaactgagtttggcgtgaatccacgagttgatacgtgccgcacggtccggtgcatcctgcagccggaccgttaccggaaccctcccccccgaaatctgacgacccccctgtctcacagctatcgtacagctccgatacgggaaacgtgcgggtgattccataacgactacgtacttcaggaagtgacgtgtatcacactatggtcatgtgttcagtgccgcagataggcgaagtttattcatgagccgaatagggccggtgaagcgggctctcactgcgttcataatacggcatatcgtgaacggcgttatcatcacagtcaggccgaattaaaggaggctcggtcatggtcgccgcatccacggcattcagcccgtcaagcacgatgacggccagtttggtggaatcgactggcctgcccagtgccgctattcctgtgcacgaggatggtaacaacggcaacggcgacagtagtgccgatggcagcggcgacgacggcggcatggtcagatcgctgagcctgtggaactacttcaccatgggattcggcgcaatcatcggcaccgtatgggtgctgctggtcggtgactggatgatcgtcggcggtggcccggtcgaggcgatgatcgccttcgtgctgggcgccgtgtttctgctgccgatcggctcgacgtccggcgcggttaccatggtcgggtcgtttctgcccggagtgctggtgatgacgccgctcttctacaccggtttcgacacgattccgcagagtgccgaagaggcaagcgaaggccttgactggaagaagttcggtatggtcatctcagcttcgctgctggccgccggcctaatcatcattggcctgcaggtgctgccgttctccccggccgcgctcaaacccacatcatgggcaatcgtggcggtgtggatttgctgggtctggcattgcgttggatcagtgcacgttcacggcgcgaatagcggtgcgccggtaggtcgcgagccgttcagtcgcgcgcgacccaaagcgtatcgaggtcgtcggcctcggtcgcctttttgcgcttgcgtacccactgttgcaggaaatacgccccatagcaggccacgatgaacacgagctcggccacgagcgcgaaccgttgctccacgtcgaaaatcaccaatacgaacgatgcggtgcacaggatgaacgccgcccaagacacgtacggatagccgggcgtgcggtatttgagttcgctggtggaatggccggactccagccaacggcgacggaacacgatctggcagtaggcgatggcgatccacaccaccacggcggacaggccggaaagcgccaccagcaccaggtacacagtcgaggcggcgatcacggaagacaggagcgccagcaggccaccggccatcgcggcgcacaaggcgagcatcggcacgccgcgacggttcgttttggcgaaccagcgcggaatcatgccttcgttgcccatcgaccacaccatgcgcgtggaggcgtacaggccggaattcgaggcggagagcacggccgtgagcaccacgaagttcatgatgtctcccgcataggggatgcctatgccgttgaacacgagcacgaacgggctttcgcccacgccggccttgcgccacgggatcagcgcgcacatcacggtgattgagccgatgaagaagagcaccagacgccacagggtggtgtggatggctttcggcacggcggtttgcgggtccctcgtctcaccggcggtcacgccgatgagttcggtgccggagaacgcgaagttgacggtcagaatcgtggcgaacaccggcatgaagccgttggggaagacgccgtccttgatgagattgacgaacatcggggcatgttggtagccggcgaccgggatgacgccgaagatggcgagcgatccgatgacgatgaacgcgcagatggcgaacaccttgatcgaggcgaaccagaattccgcttcggcgaagagccgcaccgacaaggcgtttaaggtgaagatgagaatgatgcacgccgcgctccacacccatgtggggctgtccgggaaccagcgttgcatgagcaggccggcggcggtgaattcggagccgagcgccaccgtccaggtgagccaatactggattgcgatcacgaagccggtgccagggccgatgaacttttcggcatacacgtggaaggagccggtcaccggcatggccacggacagttcgccgagtgtgagcatgaccagatagacgatgagcgcgccgatgctgtatgccaggattgtgccgatggggcccgcctgctggatggtgtatccggagctcaggaacaggccggtgccgatcacgccgcctaatgagatcatctgcaggtggcgggattccatgccgcgcttcaggttggtatgtagggcgtgctcgtctttgccatcatgtgacgactcggactggctggtttgcgctggttgattcatctgttccgaatggcttcgacggccatccgtctgaatctgcggttcctgttgcgaggacggcgactgtgccgccgtgtcggtgtcgggctgactcatgtttctctctttgccatgcgtgcgttccataggcgtcgtcgtgacggcccggaatagtatacccgcaccgaggatatagctgcgctgcatgatgctgagtcaaaatcagcttcaaggggctgatttggcgtttgccggaggtctacttccgtttcaaggggctggtcaactggcggaacgcagatagaaatggcattgttctatcgctattccgccgtttttaaccagtggctactttggcatcagccccttgaaacggaagtagatgttccgcaaagtcaaaatcagccccttgaaacggagataggcactcgcagcggctacttcaccttctggatacgcagcacgaacacggcagcgcacacggccatgacgatggagatggcgaacgccggcgtgtaggtgccggtcgtggtcttgaccacggaggtgatggtgggaccgactgcttggccgagcgtggtggccaggttgaggatgccgaggcccttaccggcctcttccttgttcggcagcacgtcgacgttgagcgcttggtcgatggctgagtacacgccgtagccgaagccggcgatgcccgcatacaggtacatgcccgtgacgctcggcatgatccacggcatcgcggtgccaatcgcgaacagcagcgaggcgatgatgactggtaccttgtgcgtgtgcatcttgtcggagatcgggccggagatcagcgaagcggtcagggaaacgaccatggtgatgatggacatggtggcgatggtgccggcagcctcggtcttggtctggtgcacgtaatcctcgacgatgtagagttggtacacggagatcatctggtagctgagcaacatgcacactcggcagccgaacgccttgtagaagtcacgcgaggtggagaacttcgggaagtggaaggagacagcgagatccttgagcgtcatcttggtgcgttccatgtcctttgaggattcctcgcgaggtcagatgtcaagcgccacgaatccggaagcccatgatcacggcgccgatgatgaagccggcttgcgcattgttgatcatgcgagagccgatcatggtgccgatgggctggccggtgaccatgccgccgccgtagaaggagtcggtgccgcacagcttaggcatcgcgattatgtgcctcgtgctcatcatccgtatctgtctattgcctctcttcttctcccaaatgcgcgcgacgcagcgtatgcaggtgctccaaccgcaaatccaacgtatccaacgcaagtacgccgcgcgtaaggatccgcgttccaaagaagccatgcaacgtgaaattatggctttgcagcagcggaataacgccaatccgctcggttcatacctgcttcgctgattcaggcgccgattctgtgctcgctgttctacacgctgcaatccctgcccgcaagcgccgccgggaatgcggaaccgttgagcggcatcgaccgcgtcatggcgggcgacatcgaatcatcgtccatattcggcgtgcgcatcgccgactcgttcggcacggtcgtctcgccgcagtcgcacgtcgtcatcggcgtggccgtggcgttgatgtgtctgatgttgttcgcgatgcagtggctgctcatccatcgcaatacgccgaaggacgccatggattcaccgcagttccgcacgcagaagctgaccgcgtttgtgttcccggccatctacgtggtgtcgggcggcaccttgccgttcggcgtgctgctgtactggctgaccaataacctgtggaacttcggccagacgctctgccaactgcgatggtttccggcgcccggatccgaggcggggagcgcaaggccgaacgcgaccatgagcgggagaaccggcaccgcgccgcctccggattgccgtctttggaagaagagcgcgcggcggccgcgcgtgaggaggcccacgtgcgccgcgagcgtgaaaagtcggtcgccagccgcaatcgcagacagcgcaagaacgtgcagctcgccaagcgttgatggcacatgggagaggttacgggggatgcgctgagaccctcgtccccggaacggttcgaagtgctatactgcttgcactacgctgcgatgcctgagtgcaaacggatccaagaccttacgatgacaggatgaacgatgatggccacgaaccgcacattactggaacaggcccgagaattgcaggcgctggcccagaccggactgatgtactgcaaggaccccttcgaccgggagcgctacgagcgtatccgcgcgatggcggtcgacatgctctccacgcaggttgatgcgccggccggacaggtgagtcgactgctcagcgccggatatccgacgccgaaactcgacactcgtgcggccatcttcgatgaagaaggcaggatcctcatgacgcatgagaacagcggggaatggtcactgcccggaggctgggtcgacgagaaccagtccattcggtccaacgccgtcaaggaggtcaaggaggagactgggctcgatgtgaggggcgagcgactcatcgcggtgcaggactgcgccaatcacaacgcgctgacctatccgtacggggtgctcaagttcttcgtattgtgcagccgcgccggcggttggttctcggccaacatcgaaacgacggaaatccgctacttcgaggaagaccggttgccgcggctttcggaaacaagaaacaccgcggaacaaatcgccatgtgttttgcggcccaccgcgatcccgactggatgacgctatttgagtgaaccccgtgaaggcatccgcacatgcgcgttgcgcggcgccgcctggtcatcgtgccgacggcgagcatcggttccgaacactgacgccgaaccgtcgaagccgttcctgtggaaaatccgtgtccaggccatgcagaaccaggtggccatcgtcatgtgcaaccgggtcggcaaggaaggcgatgtgacgttcgccggccaatcggtggtggtggacccgtacggcaacgtcgtcagcaaggccgacgaccaagaacagttgattatcgccgacatcgatctcacacagaccgcagcagcgcgcaaacagcggccattcctggaactgcgacgacccgaatggtacgactgaaggggcgaatgggcaataagcaatgtcacgattcgccgcacccatcagccgcattcgtgccggcctacagatacatgaccatacgcagattgcagccagctggtgcaaggcgggaatgtgaagtcattgtgcgtttgcttcgcgaagccgcgcaatgccggattcaaagcagctgctcatcattgctatggatgcgggactgaatggtcacttctcttggaccgccggtctcactgggggggctagcgcgtcaccgtcgttgttccagaagcgcaatgcgccttgtcgggtcttatcgttgacggatagcaagagatctccctcaaatagtgtgcgtgctgtgcgatgctccgaacgagcatcttgatgttctgcacgaagcatgaggttcctgccccaacgatccggcatgcagtcttgaaagatgcgatgcatcgcattatgctcggccgggaacgttccggggggagaggggcatctctggacagagggatactgcgtttgaagagcgcatataggccgtatcgtatgtgaaatgtgccgattcgatgccgcgcctgatactggtgaataatttcccgacggtgacgtctgtgccgttgaactgcagggtgacgattgcttccatgatgtgttgcgcctcctgctgtactatcgaatacgttttggagtgtcttcgtcggcgcgtaatttgccgatatctgtgttaagagggtccgtcgcttgctgtacgccgtccagcagtccaagcagacgagcaatgcggaggaagttctcaaagctgccattacccgtacgcagcattttggtgaccgttggcatggataatccagcccgctcggccagcaaggctacgggaatgcgctgttgtctgcgcgccaaatcgaggttgacggatatctgacgcatcgcccgactgaccgggattggtgtgcgtgtcggcatattggcacctcctatcccaaatttaaacataaattttatatctaattttcgattatccgcataaacactatactttcaagtattttgaagtatagaaaaaactcattttaccacgaatttaccacgattgaatgagccttgatatgacctataaaataacacccaaaagacatcattacacctaaatggtgtctttttaaaaagcagtcaatcctaaaactaactgctttgtgtatatggatatgaaattgtaaactagaagctgtttattttttctttttaggttttggcgttggtagttcatcatacatcacatcaaataaccccgtcagaaaatctttattatcaacttcttccaccaataacatttctttggcgttttcgtatggaatttcataagtaactgtcggcatataagaaattgcagactttgttggttttacaagtaacctatcatcatatataccgccaacgatttttccacgataataaataataaattctcccatcattgcacgatatgttatttatgtttaaatttgtatggactagccttatgcggaggttacgccaatatacgacaagaacgaaccaacgtcagcccggaatcttttcgacgatggtgttcaaggtgtcgaaagtctcatcgatttggtccactacctgcttgccctggttgaccatttcggtgatctgttccgtgcggggttgcggcaccgcatgaatcgacgtcttgacgcgcttcaagaccgcaccggcgtcggacaggtcctgcttgatggaagcgattttgggaatggaaagcgtgccgtcggagaagttcatgccggacagcagctcttcgatattgaagtccaccaacgtgccctgcgcggcactgtcgattttgggcagggcgttggtcgcggcgtcggcggccgcatccagcatgccgcgcaccgccttcacgtccgaaccgtaatacagcacgtattcggcggcctgccatagcatgccctgggtttcgtctcgcgccgcgacgatgtgactgccagcgctgtccatctgctcaagcgcctgcttgaagtcgccctgcccgacggattgctgtgcttcagccgcatattcgcccgcctgctgcgcctcgccgatcacccgttgtaccgactgccagaacagccagccggaaacgcccaccgccagcagaatagcgaccagtattgcaataacaacagtgccggtatgtttgcgcttagccataagaccaatgtacctgccactctgaccagcgtcattcacggattagcatcatggccggggcctcattctggctcatcggtatgttattggcgatgcgtagtggtggttatgcgagtgtcttttgattagtgcattcgctttttcggaacgggattgccgattctgcaggaacctattccggtaggtatgattgtttgcaatgaggaggttgacatgacggaacaagagatacgtgcgatgagagtggcggaagccgtccattctgcccgtatggaaggcggcggtgtcacatcctcgttttttgcagacgcgcgcgactatatcgaagaacaaatagacgcacacgaattggttaatcgtacacgtcgccgatacggtctggaatccgtgtgattgaactgcccgaaacctttgacacatatctgattcccggcacaaacgtactgcgcaatcttatcggtgccacaaccgttacagaacttgaagcggctgaaaacgatcttgtatctgccagaatgttggaattccaatcgaatcttcctgtcgctcaaggtactttgcgacaactgcagcagattcatcgacaattatttcaggatatatacgactgggccggtcaaatcagaacagtagatatcgtgaagggaagcagccaggtctttcagcctcttgcattttttgatgttggcgtgcaatacgccgaacgaatcctggaccgggacatcaagaccgcccgcacccaggaggcgcagaatcaaaccgcgaccgtgatgaacgccatgccgctgtccggctcgctcggggccatccgctccgcgctggccggcgacccgcgtttcgctgacccgtgtggtgaggcgctctacggcagcaaggcatgcgccgacttcgttaacgaagccaagaacatccacgcacggcaaatcgccgaacaattcgcgtcggaacagggcgtgcgggatcagccgaaatgaggcgcgatcctgcgtgaatatgctgtcatgcgattgcttgacatggctggtctgcgaatgcatgttttaccggtcgccatcgattggaatgctgacatccagctgccagtgggcttgtccggcgcgggtttggaaggtgccgccgcgtgtttcgatgatggtccggtagcggtcgaggccgctgcccaggccgagtctcgtgtcatcggatgcgatggtgtcgctggcggagacgtgaatggcgtccgtgtcgaaggtgacgcagatggcgcaccaattcgcccggatctgtgtgtttggcgatgttcgcgtacagttccgccagcaggcccgacagcagtcgcatggtctccggcgtgagcggccggtgtggttcggcgagcaggttgtcgccggtgaatcccggggcttcgagcctggcctcctcctcgtcgatcagcgattgcagcccggcacgctgcgcggcggcatcgacttccgtggaatcggctgtgcggggttgcttgctgccgtgcgagccttcatgcgatgggtcggatggacgttgcgggtggttttcgagcgagtcgatgacctcgtgcgtgtggcccatggcccggctggcggcgtcgcgcaattcgtcgagctgttgctggtattcgtgttcgtcggcgggcatgccttcggtttcggcgtggtcgatgcgcaggatcaggtaggccaggtcgttgccgatggtgtcatgcaggctgcgggccgtctccccgcgttcgtgttgtcggcgcagcaggtacgagtcatggtcgcgttggcgcatcacatgtaacagcaggccggtcaggagcggaaagcagtagaacgccagactctgcaccgcggccaccatcacccggctcctgctgagatcaaggccgtccatggtggaggcgagcaggatcatggtggcggatgacgccggcccgcgatctcgtcggtggtcagccgccgcgcgtacaggcacaggatctccttctcgcgcaatgacaggggatccctcatgtcaacagacatcttcgccggcaccgtgccggacagtagcccataggcggtctgcgcgtcacgaaaacccacagcggcctgttcgtcggcgggaaggccttgagccgcccagcgtatcgccacggcgatatcggtcctcagtcgttccttcgcgaacagtccctgagcgccggacgcgatcgcctcccgctggtagacgtccacggaatacgaggtgacgcacacgatgcctgtcccaccggtcctgcgccggatgcgccggcacacgtccgcgcccgtgatcccgcccaatgccatatctagcaccaacacctccggcctggtatgcgggttgtggcaatgctcaatcgccaccgcgggagagcccgtgctccacatgacgcggaagtccttggaaacggccgagatcatcgcgcacatcgcgtccaaggcgaacggatcattatccaatacgccgatacggattgcccgcgccgaaaccccaaccatatcatcatgcctcatgccgctcatcgtagccatgcccacagccggatgaaaacctgttgtcatgcgattgcttgacacgatgtcgcgggcacgtcgcagccggaccatattgggtgttgttgattccgagtagaagaggggagctgtgatgatagagatttccggtttgtcgaaaacgtacggcggcaaacaggcgttggatgatgtgtcgtttcgagccgagcagggcaaggtcaccgcgctaatcggtccgaacggtgccggaaagtcgacgttgctgcacatcctgctcgggttggagcctgccagtagcggcgcggccacgttcgatggcagccgatacaacgaactggggccatctccgtgcaatatcgtcggctcgttcatcgacgggttgacgccgcatccgtcccggacgggactcagccatctccgttggattgcactggtcgccggcgttccgttctcccgatgcgacgaatgcctgcggctcgtgggattgcacgaggcgcgcagacggacgttcaagacctattcgcttggcatgaaacaacgtctgggcatcgcggccgcgatcctgaccgacgccccgtatctcatcttggacgaacccttgaacggcctcgacccggaaggcatccaatgggtgcgcgacttcatcaaggattacgtttcggatcaccgtaccgtcatcgtctccagccattacatggccgagctcgaactggtgaccgatcacgtcgtgggcctgtcgaatggccggaaggttctcgatggtgacatcgctgcgttgctcgaccagtacggcagccttgaacaggcgtatttcaacgtggtgaagaagtgaggctgatgaagatgacatctttgccccgccatctgtcctgccagctggtgcgatactgcgcaaactggcaattctactggtccgtatgcgccgttctggcactcaccgcgctgttcgcggtgctcgacgtgcagacgatttcctcgacggtgtccatcacggcaaacggtaccgtacaatcgcacgacgcattggacccgaacctggcgcatatcgtgtccgacgccatgctcgcctcgccctaccagacctcaatcattctcatccctattatcgtggcgttgattgtggcggcgggattccggtcgggcgatgaacgccagctgcggctgctgtataaccggccctatccgttcgcggtcagtgacgtgctcgcgaccgtgctctactgcatagccgtctcactgctgtcatcactgctgaatgcggcgatactcgtggtgatgttgaatcccgcgctgcgaccgatgttcctcacggctacggttattaccacacctctgagggtgatggcgttcgccgtggtcatgggactgatcggctatatcgcggccttgtccacgaagcgtgacgtgccatcactggccgtgattctgctgctacttgtcgtttcgctatccggcgtgctgaaagtggttcacgctgatatggtgctgccgacgatcggcgggaaaagctttgcgttcggacgggacgatgaggcaggagaatttccggtggccgcatccgcaatcgtcatgacgtgttggctggtggcggtgtttactgcggcggtgatggtgcgtagccggcttttcctgaaatcgaaagtatgagaggggcgtgatgtgacgagcatggttaaagccctgatatacaaggacgcgacaacacgaatcctgcgggtcgtttgtctgctggctatgtgctgggtgtctctcgtgtacacggtcgctctgatgccgattagtttggacgattccggaaccaacccgctgaccgtcgaaagcagcacgacacttgcctcgcaagcgctcgtgatcatcgccgctgctctggccattatcgaaatcaattcgggcgaaacggcgatagcggctctcctcgtcggttcccggcggcgaatggcgttttccctgatgacagcgaaagtcgtgagtatcgtcgttgtcgggttgatgctgaccatggtgaacgccattggaaacttcatcgcctacggacacggcgtcagcggccgtctgatgatccggtacatgatgctggtagtgatgaacggcgttgcggtactgtcgctttctttgcttgccgggaatgtgctgctcggactatccatctacttcctggtgcccatactgcttaagccgttcatcgtctatttggtgccggctgtcagtgacttgttctattcgtcggcgattcgctcgctggctgatggtgcgttgcctttgcagaattcattagtgtcgctcgtgtggttgctggttttcctgctcgcgggatatttatcaatagtcgtgcgaatccttgaatggtgagagtcgcggacgttgtagattgcgggatgagtgcgggatgcaacgtgaatttcagcgtttttcgtctatcatcccgcagcatttcttacgagtgattatggctcaacatggaaaatggcgtaatcccgcgattttaataattaatgatgtgggatgctacgtgcgtcaaacgattgatctcgatggcatcccgcagtactgcgggacgtcacgcaaaaaatggccagatctgtgtgtcatcccgcaaatgtgaagatatatttgagtacatgcatgccgtaggaatttcgggcacaagctgattgactagaagaagcgaatcatatccgtgaacaaggggagaagctcaattgaatttgaaaacagaactgcagacggaacgacttctgttacgcccgtggaaaatcgatgatgttgccgacgcgaaggcgctgttcaagtatgcaagcaatccgcacatcgggccggccgctgcatggccggtgcatgccagtgtcgaggacagtgcgcgggtaatccgtaatgtgctgagcactcccgaaacatatgcggtcgtcctgaaggagacgggggagccaatcggcagtatcggattggcgccgttgtcggacgcagtcgaccccgagcgtcgcgagccggagtcgacgcgcgagatcggctattggatcggcgaaccgtattggggccaaggactgattcccgaagctgggcgggaaatactgcatcacgggttcgaggacctgcaactgaccgcaatctggggcgtgcatgacgtcaacaaccacaaatcctcccgcgtgatggacaaactcggactagcacccgtgcgcaccgcccgccatgtgcatctcaaactgctcggcgacgtatatcgcgacgaactcgtacgccgcatcaccgcagacgaatggctaaccagataaagtcccgatgtctatttagaagtgcaacacccttgttggtcctgtaattctaacagttgacctcagcaccgtcaccacctgacagacccacccacaccaaacagcgaaaggccaaaaaatacatgactaaacacgaaacaccgacttgacgaaatacagcctgattgcaggcatataggcactagttagcgaaaccggctctttgcattttggtgcgtaggggccgtgcggtttgattcggtgtgtgattgaaaaagtgaatgaaaccgcacggcccctacacgccaaaaccggaagagcccataaagtcccctcagtagcgccaacctgccagtcctttggcggaaccacaccacatagaccttcctcaacggcgccaagctgccacacgctggcagaccaacaccgctgtgtgcattctctgcgtcggcggcagtccaaaacttggcccagcaacgacgcttgctgtgcccagcgtcggcagagggccaagaattggacgcaaacgacacagaacacaccctcagcatcggcagaactccaagatctgtaccgctgacgacggtaagccctccacagcgtcgtcagagatacaaaacctgtcccaacaccgacgcctgccacccccagcgtcgccggagtcccaagtctcggcccagcaacgacgcctacgaaccccacacataagaaaccgcacctccgatcatcgaatctgaattacttcagtccaacaaccggggtgcggttcactgaggggagttctgccagtatagctatatcagtcgtcgccgagcgtgacgtgcacgccgccgaccagcgagctgaccacgttgtagatcagtgccgcaatggtggccagcagggtgaagatcaccacttcaacaatcgagaagatggtgacgccggagaccacggtggtaagggacaacacgttcttgagatcgaaaccgcctgcatcaagaccggtggaagacacaatctgcgtaatctggctgaatacaccgaccacatcaagcagcacccatacgatcgcggaggcaacgacctgaataatcgccacggcgatggacagcatgaacgtcaccttggccacggaccaagcatccacgcgggtcagcgacaagctcatgcggcgagccctgggggcgctacggcgaggtgccggacgcacgggagtggcggcacctgaagaaggcaacgcggattcttccggatcgctggacacggagcgtgccacgcggggagcgtgctcagtaccgatcagcggctcgacatgctcgttctgcgtattgccgactgccggcggtatgatccggggctcgttgtcttcgagattctcgctcatcgtttctccttaacaggcttggcggtagcctctgctgtatgcgaggctaccagcttttcaggacgctgctcacgcctcgtccgcgttgttcacattctcgccggattgtgcggtctcggcggtgccgttcgccgcggcatcgccgccatcctcgggctcgtccttctcctcgttacgggcgatggagagaatcgtgtcgcccttgtcgggcttggcaaaggtcacgccctgggtgttgcgcccggtgcgcttgacttcgtccacgttggagcgaatcaccttgccggacttcatgatggccataacctgatcgtcttcggacaccacgagcgcgccgaccagagcaccacggccctcgaccagttgcacggccttgatacccaggccattgcggccctgcagacggtattcgctgatggcggtgcgcttggcgaagccctcgttggtgaccacgaacaggtccttgtcggagtcgccagggaccacatccatggtcagcaggctgtcgtcgttacggaacttcatgccctgcacgccggcggtctggcggcccatcgggcgcagctgctcgtcgtcggcctggaacttgaggctcatgccgagtttggagaccaggatgatgtcgtcctcggcgttgcacagcgcggcgccgatgagctcgtcggcgttctcgccgttctcgtcggccatgaggcgcacggcgatcaggccgccctggcgcggggaatcgtactcggccagcggggtcttcttgaccttgccggaacgggtggcgagcaccagatacttggccacctcgtagttcgggatggacagcacggtctggatggactcatcaggcgcgaactgcagcaggttggccacgtgctggcccttggagtcgcgcgagccctcgggcagctcgtaggccttgatgcggtacacgcggcccttgttcgtgaagaacagcagccagttgtgcgtggaggtcaggaagaagtgatccaccacgtcgtcctcgcgcagcttggtgcccttgatgcccttgccgccgcggtgctgggagcggtattcgtcggccttggtgcgcttaatgaagccggagtgggtcacggtgaccaccacgttctcttcggcgatcaggtcttcgacgttcatctcgccggagaacggcaggatcttggtgcggcggtcgtcgccgtacttggcgacgatctcgtcgagctcgtcgccgatgatcttgcgctggcgttccggcttggcgaggatgtcgatgtagtcggcgatcttgcgctgcaattcctcatgctcggccacgatcttgtcgcggttcatgcgggtcagcgtgcgcagctgcatggccaggatggcgtccgcctgcacctggtcgatgtccagcagccccataaggcccgtacgtgcggtgtcggtgtcttcggaggcacggatgagggcgatgacctcgtccagcatgtcgagggccttcagatagccctgcaggatgtggtcgcgctcttcggcctcgcgcttcaggtacgcggtgcggcgggcgatcacgtcgagctggtggttcacccaatggcggatgaaggcgtccaggctcagcgtgcgcggcacgccgtcgaccagcgccagcatgttggcgccgaaggtctgctgcagctgggagtgcttgtacaggttgttcaggaccaccttcggcacggcgtcgcgcttgagcacgagcacgaggcgctggccggtacggccggaggtctcgtcgcgcatgtcggcgatgccctggatcttgccgtcgcgcacggactcacgaatggagacgacgaggcggtccgggttgacctggtagggcagttcggtgaccaccaggcacatacggccgttgatctcctcagtgttgaccacggcacgcatggtgatcaggccacggccggtgcggtaggcctgttcgatgcccttgtggccgaggatggtggcgccggtggggaagtccggtcccttgatgatgcggatcaggttttccagcagttcctcgcggctggcgtccgggtggtcgagcgcccagtggacgccgtccgccacctcgcgcatgttgtgcggcgggatgttggtggccatgccgacggcgatgccggcggagccgttgacgagcaggttcgggaagcgggccggcagcacggtcggctcctgggtcttgccgtcgtagttgggcacgaagtcgacggtgtccttgtcgatgtcgcgcaccatttccatggccagcggggccatacggcattcggtgtaacgcatggcggcggccgggtcgtcgccgggggagccgaagttgccctggccgtcgacgagcatgttgcgcatcgaccaggactgggccatacgcaccaaagtgccgtagatggcggagtcgccgtgcgggtggtacttacccatcacgtcgccgaccacgcgggagcacttgttgtagccgcgatcggggcggtagccgccgtcgtacatcgcgtagatcacgcggcgatgcacgggcttcataccgtcgcgcacgtccggcagggcgcgctcgacgatcacggagagggcatacgccagataggactcgcgcatctcctgctgcaggtccttgcgctggatgcgttcgccggtgtccatcaggccgtagtcggtagtgtccgcctcctgcgggctcaacggctccatcgagccgtccggcgtgaactgctcgtcgccggtgttgttttcatctgccactgttgttcctttagttgtctaagtccgttgtgtacctccctctgacgagggaggttggaggattccgctacgcatcgatccaacgcacgttcttggcgttgcgctggatgaagaggcggcggggttcgacctcatcgcccatcagcatcgagaaggtctcgtcggccgcggcggcgtcctcgatgtgcacctgcttcagaatgcggtgctcggggtccatggtggtctcccatagctcctggtagctcatctcgcccagacccttgtagcgctggatgccttcgcccttgggcagctggcgtccgttggccttgccttcggcgagcacgcggtcgcgctcggcgtcggtgtacacgaagtcgtgcgggcccttggtccacttcaggcggtacagcggcggcatggccacgtacacgtagccggcggtgatcatcgggcgcatgtagcggaagaacagcgtcaggttcagggtggcgatatgcgcaccatccacatcggcatcggccatgatgatgaccttgtggtagcggaccttggagatgtcgaagtcctcgccgtagccgccgccgaccgcggtgatcagcgattcgatggtgtcggacttcatcatgcggtccaggctggcgcgctcggtgttgaggatcttgcctcgcagcggcaggatggcctgcgtgatcgggttgcggccctggatggcggagccgcctgcggaatcgccctccacgatgaacagctcgcactcttccgggttggaggactggcagtccttgagcttgtcgggcatgccggcggactcgaagatggacttgcggcgggtattctcgcgggctttcttggcggccagacgggcacgggaggcctcgatggccttctggatgatgttcttggcctcggccgggtgggcatcgaaccagtcgccgagcttgtcggtcatcacgcgctgcacgaaggtcttggcttcggagttgccgagcttggtcttggtctggccttcgaactgcgggttggtgagcttgacggagatcacggcggtcaggccttcacgcacgtcgtcgccggagaggttctcgtccttgtccttgaggatgcccttgtctcgcgcgtaacggttgaccagcgaggtcagcgcggcgcggaagccctcctcatgggtaccgccctcggtggtggagatcgtgttcgcgaaggtgtgcacggcctcggagtaggcagtggtccactgcatggcgagttcggcggagatgccgagcttcaggtcttcggcctcgaagctgatgacgtcctcttccaccggcgtggccttgcgcaccttgaccagatagtcgacgtagtccttgatgccgttgaggtactggtaggtgacggtctggtgctttgcgccgggctcgtccgcggcgtcgccggccacctcgtcgccggcctggtcgttctcacgctcgtcggtcaggctgatcttgaggcccttgttcaggaaggccatctgctggaagcgggaacgcagcgtctcgaagtcgtagatggtggtctcgaaaatcttcgggtcggcccagaaagtcacagacgtaccggtggactcgccttcggtcatcggctcgccctgcttcaagggcgcggtggggtgctggtcgatgtacgtctgggtccagtggaagccctgacggcgcacttcgatgtccacgcgggtggagagtgcgttgaccacggagatgcccacgccgtgcagaccgccggacactgcataaccgccgccgccgaacttgccgccggcgtgcagcttggtcatcacggtctccacaccagagacgccctcgccgggcacctcatcgaccgggatacctcgaccatcgtccaccacacggatgccgttgtccggcagaatggtgatctcgatatggctggcgtatccggccagcgcctcgtcgaccgagttgtcgacgatctcatagaccaggtggtgcaaaccgcgcgggccggtggaaccgatgtacataccggggcggatacgcacggcctcaagtccttcgagcaccctcagatcggaggcctcataatgctcgggggccatggattcgtcaagttcgccttcggtcaattccgcattgttgatgcgttccgcagccgccttcagctgctcctctttgctggtttcgtctgccaacaggcttccttccgtgactacagggtcaacctccgtcatgaaggtcattcacggaggcgatatggcttacgaggcccgtaaagggctcttctagccatttgaccatactgcatgtgattttactcgtctaacccgacgagcgccatagcgaggcttctgcgaatttgtttggtatcttggctaccgccgccgagcccatttgcgcgtgtatccggcggccgggccggtcacgcgaatctcggtgatggtcaatcctttgagattgcgacggatggtatcggtgagttgggggataaggtaggtcagctgcgtggcccagaccgtggattcggcgcggatggtcagtacgccgtcagtgaaatcggcgactgccgaatggctggcgatggcctgacccaccacttggtcccaatggttgcgcaattgcgcaagcttcatattcgccgtccagacgccgttgccggcgatggtggtcatcacgctgcccagttcagccggatcgcgccccggtttgccgaagttttcgatggcctcttcacggcggcgtctgcagtccttcaaggtcgccccgcgacgggagagccgctcgaatatttcggccggcagtttggtctcgtccaggttgagttggcgggcgatcggcgggttcatgacactttccgttctacggacgcgctgtccaccgcggttttttcgtcatacccacccaaactctcattttcccgcgaattggacaaattgcccagagttggcaatatcacggaagctggttcgtccagtgcggccacgtcgatgcgatgggccgattcatagtcgggcacatcgccttcagcggccacggtaatcagcacctgatcctgttttctggcgaaatcaagaatctgcgtgcgccggctgtcgtcaagctgggcgaacacatcatcgagaatcacaatcggctgcaatcccaaccggtcacgcactatttcgaacaatgccattttcaaggccaacgccatcgtccacatctcgccgttcgaagcgaactcgcgggcgggaataccgcccaactcaaggttcatgtcatcgcgctgcggaccgataaggttcacgccgcgagccacttcaccggggtagatgcgttggaaatgctcgctaatctgcggatgcggatcgtcgaacatcagcacttcgtcgaatgaaggcgcataagtgagcgtcacctgctcgccggcaccggccaagtcggcgtaaatcgcggcaaatggctcggcaagcagaccgatcacatgagcgcgcatacgggtcaacgccacaccggcttcgatgaactggccggtccagatttccaaaccgctcagaaccgcatccatcggctggccattgttgacattggcattcaattgcttcaacaatgtggcacgctgtttggcgatgcgcgtgaactgttgcaacgtctgcatgtatccgggctcgagcagagccgcagcctgattcatcatggtgcggcgtgctcccggatcgccggacaccaaccgctgatcttcgggagtgaaggaaacgctgggaatcttgccgatgatatcgcgcagatacagcgacgaccccgagttgatgcgggctcggttggcaccacgcgcatgaattgacgcttcatacgtagtggtttgaccggcatcatcagcgacgttcgcgcggatagtggccgtggtctgcccgcgttcgatcagcggcaacgtgctggacgtgcgatggctcgatccggtggacagcacttcgacggcttccaccagattggttttgcccagaccgttcttgccgaacaggatattcacgcctggtacgaaatcgaccactacctgactccatgagcggtagtggtcgagtgcgagacgggagatgtgcattagcgaatcgttggaaattcagggatttcagttgttaaagcgcatcggcacgagcaggtatcggtagtccatggactcgtcggaatcagcttcctgctggccattgaactcgaccggcttgaccggggtcgtcattttgatgcgcacgaatggttcggttacggcggacagaccctccttcaggtaggacgggttgaatgccacggtgatgtcgtcgccatccatgtcgatgtccagtgtttcgttggcctgagcctcgtcgaccgatccggcggacagcgccacttcctgaccggtgaaggtcatgcgaatcggagcattgcgttcggcgaccaaagccacacggctgatggcgtcgagcaaatcctgcttgttgactacggcctgaatcggatattcgtcggcgaacaggcggtcgaccgccgggaattcaccgtcgatgagctgggaggtggagacgcggccggcgttttcgaagccgagcagcgtcgggctatcggcatcgaaatcaaggcggatgttctggtgctcgtcaagagcacgggccacatccttgagcagggagccgcgaaccagcgtggtggtgtcgacgtccgggttctgcggagtccaagtgaaggtggcgcgggccaaacggaagcgatcggtggaggtcatgacgaccttgtcgccttggaattgcatgcgaacgccggtcagtaccgggcggttttcttcgcgggagacggcaacgcacgcctggttcacggcctgaacgaaagtcggggcatcgacttggccgagcatggccggtaccacaggcagatccgggtactcggtgtcgggcatgagctgcaaggtgaacttcgacttgccggacgtgatggtcagcgtggagccgtcggtgaccaggtacgttttctccgaacgcagcgatttggtgatatcggccagcagcttgccctgaaccagtacggaaccggcttcgtcaacgccggcttcgatgtggtggcgagcggaaatctcgtagttgaaggcggagaattgcagcgttccgtcaatggcttccagcttgacgccagcgagaatcgggttggagggacgtgcgtcgatgactcgggaggtccaggctacggcgtcggccagggctgcggtatcgatttcgactttcatgtgtgattgttcccttcgtcggattggctgagaaatattctagccgttaggtggcgaacttacgtacgctggatgaccggctgttactatggcgatgatgctttttcacgtaactgagtaagtaatcgccataataaggccggtggatagtgtggataagtagggctgagccctacaactgcaacggttcataagtccctgaaaattgtggacaaattctgcatggcttgtggataagtgggcgagttttccacagccagttcgtcgaatttgagttttccacatcgaggtcgcggttatgcacgagttttccacaacaaaacagtgggtaatccacgagttatccgccgagtttacccacatctgtgcacaactatgtggataacttttttggttttcgcactttcgcacggcgtgttgaagactgtttttcgtcgaggagaatcgattctggagaccgttttcggcacttttccgtctcgctcgcccaaacccgcaaaatcggtcctcagaatcgattctctcgtttcatggtttttttgcgtgttccccttcgaaactcccctcagtcgtctgcgccgacagatcccctcacaaaggggagccatgaggaatctaatgtctcgaatccgttgcctcgacgtatccaccagaatccgcctgagcaaccaaaaacggcacttttcggaaagtcagtccaaaaagtgccgtttttcgtctctcagaagcgttgtgtcagttggtgttgctttgcttgaggcgaaccgtgagctccataacgtagttatagatctcctgtttttgctgcattcggtcactgattcgagtgcaggcatgcattactgtggtgtgatcgcgtccgccaaagacctggccaatatccatcaggctcatactggtcatttcgcgagccagatacatggcgatctgacgaggaacagccacgtttttggttcgtgatttaccgacaagatcctcaaacgtcaggtggaagtacttcgccacctgactgatgatgtccgtgggcttgatttccacatcggtggtgaagaagtcctgcaacgtctgctcggccaaggcgcgggtcaccggctgattactcagcgaggccacggccgtaacacgggttagcgcgccttcgagttcacgaatgttctcggtgaagcgttcggcgatgaggtccaacacatcgctggggattttcgagccgttcatcgaggcgatcatgcgaagaatggcgattcgggtctccagatccggcggcttgacgtctacggtcaggccggattcgaagcgcgagatgagtcgagcctcgaaacccttcaaattcttgggcgctacatcggaagcaatgacaatacgcttatttgcctgatgcagtgcattgaacgtatggaagaactgatccaaggtggcttccttgccgccgaggaactggatatcgtcaataagcaacacatcaacctgtcggtatcgacggttgaattcagcaatctgcccctggctttggttcgggttttgcagcgcgtcaatgaattcgttcgtgaattcctcagacgtgacgtatcgaaccttcagcccgggatccttgaccagtgcatagttgccgatggcgttcagcaagtgggttttgcccaggcccgatccgccatagatacacaacgggttgaaatcctgcccggaaccttcggccacggccagtgcgaccgtacgggcaaaacggttggaatcgccgggcacgaaggaatcaaacgtgaagttcttattgagatgagtctcgggatcgcgattcatcttctgctgaccgaccgggaactgcggctcggtggcgggcatcggttcccgcggtgcggctgccggctttgcaccataggattctttaccgaattcggcgacagtcggagaaatttccgaaggatatggctgcgccggctttgcctccgaaagcggttcgggctcggttttcggcacgaccttgaacgcgggaaacatattttcgccggttaccgtacgcaatgcctgaagcagggaatcgttcaaatcaccctgaatggcttgaagcgtgtcgttgttgtccacacacagcacgatggtcgaaccgaagacgccttcaggaacaacgccttccaaccagcctttttctcgtgggctgagcgaagcgctgtgtttgagcaccgtcagcgtgtctgaccagatgtgggcggcctcgattacggggtcgccggaagcgttaaccatggtggccccttctgtcgctgtggcgaaatacgtacaacagataatatttactctggtttagacaagttatccaccgtgtcgcgtgttgaaataactggattgtgaataacaaacatgtaatttgtggataacttttggccgtgaatggttggtattccgccgattataagagatttggggcgtgtctcgcaacgtgtcgaaatgtgaaaatactccgtccgttttgacttgagggtaggggtgagagtactttggtatagcttgactcacgtgagggcagcgcgaagcgttgccgaatagacctaggagcaatggattatgaagaggacgttccagccgaacaaccgtcgtcgccacatgaagcacggcttccgcctgcgcatgcgcacccgttctggccgtgcggtgatcaaccgtcgccgtgccaagggccgcaagaccctctccgcctgatcattccgatcagtgccacaggcatagtcgaggtggagaggcttcaaagccatcgtgatttcgtcaccgtgctgaaacgccggcgcaaagcaggtggcaaggatatcgtcgtgcactatttggtgcccgacgaccatcatgatgatgacgaccggacggtgcatcgccgtttgggattagctgtctccaaatcggtaggacatgcggtcacccgtaatacggtgaagcgtaggtttcgtgtattggccagagcccatgaggatctgctgcccgcgcattgcgatatcgttttgcgcgccaagcccagtgcagcgaccgcatcgttcgcttcgctagatcagcagatcgcgaaggcttttgccacggtggcgcataaggtggctgaggcatgacagcttctttcaaggcggtgatgattggtggggtgcgctggtatcaacagcacatctcggcaaacacaccgccttgttgcaagtattatccaacgtgctcgaattatgccattgaggcattggaacggtatggcgcgttcaaagggggagtgctcgccgtgctgagattactgcgttgccggccgtggagtcgtgggggaatcgacgatgttccacaacggtattccgttttttacaggttttcgtggtcgaaggctcatgaagagcctcgactgacaccattggccacaacccaaagagaggcccaacgatgaactcaaatgaatttctgcttgatagcgggttttggggatttctatataaaatcctgactcccgttgagtggttgcagacctggatcatgaagatcgtgcatgacttcttcgtgatgctgggcgtgagcccgattggtgtctcatgggtgcttgccattatcatcctggtgctggtggtgcaggcttgtatcttcccgctgttctacaagcagatgaagtcgatgcgcaagatgcaggcattggcgccgaagatgcagcgtattcagaacaagtacaaaggcaagacggatcaggcttccagggaggccatgagccgtgaaaccatgaaactgtatcaagacaatgacgtcaatccggctggctcctgcttgcctatgctcattcagggcccggtgttcatgtccatgttctatacgctgtcggccattccatacattgccaacggtaaacgcgatgcgttgggcgcgttcgacgtagcaaccgccaagcaattcacccaaaccgatgtgttcggcattgtcagcgtgaccgataacttcaccagtgctgccgctagtggcaaggcggtcatcggtatcttcgtgttcctgatgtgtttctgcctgtggtttatgcagtacttcagcatgaagcgcaacatggcagctgcttcgatgaacaagcagaccgagaccatgcagaaggctatgctgtggctcttcccggtgatgtacatcttctccggtgtcgccatgccgttcgccgtgctggtctactggctgaccaacaacgtgtgcaacctctgccgcacattgtggcaggtgtacgcattcccgacccctggctctccggctgcggcggacaaggagaagcgcgatcatcgtaatgagaatgctcgccgcgcaaaggccggcctgccctctctggaagaagaagcattggccaaggccaaggaagaggccgagcgtaaggccactcagggctatcagcgtcaacagcccgtgcgtaagcgcaaaaagaagtgacgactatgtcggtgcgagttcgatgtttcacgtgaaacattcaacacgcaccgacattactttctctgttcgggggagcagggcttagacttggaattcaaacacgacatgaaggagtagcgtatggcacaggatgacgtgaagtcgatcgaccagctcaacgaagaggctgacatcgccgcggattaccttgaaggcctactggatatcgccgactatgagggcgacattgagatgggcgtgcgtaatgaccgccccaccgtgcaaatcgttgctgatgacgatactgacatcaaacatcttattggccgtaatggtgaagtcgttgatgctctgcagcaattgactcgtctggctgtacagcagaagaccggcgagcgttctcatctgattgtggatgtcgacggtttcctgaagcgcaagcgtcagcacctccgtgatatcgccttggatgccattgacgcagtgaaggattccggcgagccgtatgacttgaagccgatgaattccttcgaacgtaaagtcgttcacgatgtggttcgggaagaggggctgaagtctcgctcgcacggtgaggagcctcatcgttacgtgacggtgtatctcaagaatagagtcgaggataccgccgaagacgacgagcttgatcaggagtaattgctcggcgagtttttttgagatgacagggacgttcgacggatgtcgtctttgaacaaactaaagtgaccgcatggagaatggcgtcgtaatgagcggcgccattctccatgttgattgtttcacgtgaaacatggtgagggagatggctatgacggatcagctgcaggggtcacctgtacttgctgaggtcttgggtgatgcgttgccgaagttggagcgtttccatgccaagattgccgaagagggtgaacctcgtggattgatcggcccccgtgacgtcgatatcatttgggaacggcatattctgaattccgctgcgattgtgccgtacgttcggaatgcgacgaatggtattcgcttcaaaacagttgccgacgtcggcagtggtggtggttttcctggattggtggctgccgcgtgtttgccggatcatgacttcacgctgattgaaccgatggagcggcgaatcgaatggttgcatgaatgtgttggcctgatgcaactgcagaacgttgagattattcgtggacgctccgatgccgtcatccagcaggtacggaagcgggaaattcatccgttcgctgttgtcacgtgtcgtgcggttgctcctatgaccaaactctctggctggacgttgccgttgctgaaaccgtcaggacagttgatcgcactgaagggacggtctgctcaggctgaaatcgacaaggctggcaaggagattgcaaaattcggtggtcgtcgtccacgcgtcgttgaggcggctgtcggaccggatcttgagcctacccacgtggtgattgtggataagcgatgagtggagtactgattgagttatccacatttccatatgtgcgtaaaagttatccacatttttacgggacgatgtgcagaatgatgaaaacactgatttttcaatgtttttcgtctgcgaatacataatctaacactcaacgtcattcacacttatccacacttatccacattgcatatcgcaattgtggataacgagcatcatgtccatacgaatgagaacactggaacttacgtctgtgcaaggaggagcgatggccaccaaggatcatcagtcggaacctatagaatcggcttccgaaacgcttcagcgaatattcgatggtcacggttcagtgcttggtagccaaatggctgatgaaagctcacgctacgatgtactcaagaaaaccgatttcccaaagcctcaacggactcgtcgtatcgccgtggccaaccagaaggggggagtgggtaaaaccacatccacggtaaacaccgctgcggcgctggcgaacaagggcgcgcaggtgttggtcatcgatatggacccgcagggcaatgcctctacggcgttgggtgtatctcatgcatcgggagagccctcggtctatgacgttatcgaggggcgttccgatctgggtgatgttatcacggtctgtcctgattttcccacacttgatgttgtgcctgcatcaatcgatctcagcggtgctgagttggaagtggctgatctgcccaaccgaaacacgttgctgaaggaggccctagacctctacctacgtcaatcagataaacactatgattacgtgttcattgattgcccgcccagcttgggcctcttggtcatcaacgccatgtgtgcagtgaccgagatgctgattcctatccaggctgagtattacgcattggagggtcttggccagctgattaacacgattggtttggtgcaagagcatttcaatcccgtactgctggtgtccaccatgctcgtcacgatgttcgatcgccgaacgttattgagccgtgaagtatataacgaggttaagggacactatcccagcattgtgctgaataccaccatcccgcgttcagtcaagatctccgaagcgccgagtttctcccaatcggtgattgcctatgatcctcgtggcataggtgccatatcgtatggtgaagcagctttggaaatcgcacagcgttcgcaacaagtccttgacaccattgatgcgaggaggaacaagtaatggcatcaaaatcacgacttggtaagggccttggcgctttgttccccacattgccaggggaggagccggtggcggagcagcccgcaatgattgcggaggattcgtctactccggaggccactgctgacataacccccgccaagaaggctactgcccagcaggaatcaaaacctgccgtgcctcagacgatatcgtccagcaaggcagtcaagaaagccgccggtaaacgcgcatccatgcccgcattggacaccattactcatcctagcgacctgtttttcggtacggagaaacctcaaaccggtaaggtcgccgcacctcagcagggcggcaagtcgtctgcgtctcagacggcacatcgtacatccgtcactgtcaaagatgtttcacgtgaaacatctttgactgcatcggcggcaaagaccgctgacacagataagaaggacgagctcaagccggtagccggtggttatctggctgaactcaaactgtctgatatcgggcccaatgcacatcagcctcgtaccatcttcgacgaggatgagttgaatgagctgtctgcttccattaaggaagttggtgtgctgcaaccgatagtcgtgcgcaagcgtccggcaagccagattgctgcggccaaagccgccaagcacgacgagacggaatccagcacgaatccgtttgccggtcatttggacagcccgtatgagctcattatgggtgaacgccgttggcgtgcttctcagttggctgggttggagacgattcccgccatcgtcaaaaccactgcggatgatgatatgctccgcgatgcattgctggaaaacttgcaccgtgtggccttgaatccgctggaagaggcggctgcctaccagcagatgattgaagagttcgggttgacacaagtacaactgtccaagtcggtgtccaagtctcgcccgcaaatcgccaataccttgcgactgctgaacctgccggcctctgtgcaaaagagagtggctgccggtgtgctatcgtccggtcatgcgcgtgcgctattgggcctgagcgatccggaggaaatggacaagctggcttctcgtattattgcggaaggtctttctgtacgcagcaccgaagaaatcgtcgccatgaagattgcgtcgggggagcagccgaagaagcctaagacgtctaagaccaatccttgggttggttccgccatccagcagagtttggaaaatcatttcgataccaaggtgtcgattaagggcagcaccaagcatggtcgcatcgaaatcgtcttctcgtcaccagaggatatggatcgtatcctgcagctgctggtgccgagccaaggcgatgccgattccaaatgggtgtaacgcgataagaacattcgtgttgtcgccggcattattgctgtgcagtgcgttgtatgcgcaagacgttatagcctctgcgtgattcctggtaggggcgtatgcccgcgctgtagcccctgtcgcaatagaaaacccctcaggctggagagacaatcacacatcgtgattctccgtcgcctgaggggtctttctatgcctttgaccgatacgtactatccaagggcggcatgctgtaacactgacctagcgttgctcctatgtcacaggcagcagccagaacagcaagccaccatcagtccgccaccatcagtccgtaagataggcctgcgcatccagcgctgcacggcagcccatgcccgctgcgctgatcgcctgacgataagtacgatccacgcaatcgcctgcagcaaagatgcctggcgcactggtcatcgtgctggcaccctgcaccacgacatatccatcatcgtcacggtccacaacaccggccgcaaaatcagtggctggcgtatggccgatagccacgaatacggcgttggtgtccagcgtgctttcttctccggtcaccacgttacgtacggcaatgctgctgacactggccggtgccacagccggtcgtttgattgtcaagccaggaatggcaacaggtgcaccggtgttctgtgtgggggaggaggtgccggtaatggaggtcaccactgtgttggtcagtagggtgatggtcggattggctttggctcggtccaccatgatctgcgaggcacggaagctatcgcgtcggtgaatcaaggtgaccgaagaaccgaaccgggtcaggaataatgcctcttcaaaagccgaatcgccaccgcctacgaccacgataggcttgttcctgaagaagaagccatcgcaggtggcgcagtacgagacgccatgtccggacagctcctgttcgccgggcaccccaagcttacggaatgacgaccctgtggcgatgatgagtgctgatgcctccaactgggagtcatcggagagcgttacacgataggtcggcttgaccgaatcactctcacacgcctcaatggaagagacatcgtctgtgatataggttgtaccgaagcgcttggcctgttccttcatgcgatccataagatccgggccaagaataccttccgggaatccggggaagttctccacctcagtggtgttgaccaactgtccacctggcgacaacgcaccagtgaccataacaggattaagacctgcacggccaagatagatggcggccgtgtagccagcgggaccagaaccgataatgatgacgttatgtttcacgtgaaacattgtcacacccccatacgatattccatgtcattcagccagacgcgaagaaagggcggcaccgtcgaatgtatgcgaacggtaccgcccttcttgggtcagttatcggtatagatgccgattagaagacctccaccttctcgatgtacagctggttctgcggcaggctacccgatggcacccacagcagcagatcctgcgtattgacggctttggtgaacttcacctcagtagtgccaccttcagcaaaggtgaattcggccacctgctcgccctgagtggggtctccagtggtatttgcgcgaatatagcccttaccaccggatgtgcggatggtgataaccatgcggtacgcatcctgcggctggtcaaggtgcatgtagtatgcgtacccggattggccgccaggattcgacaggaagttggcgctggaaatcgtaaacgccgtgttgttctcatggcgcggttgcggagcagcgctggaatccttatcgccggacttcttggccttggtcttcttggacgacgaatcagcagtctcggacttcttggacttgtctgatgctgagtccctggattcgctctgagtggcatcactcgactttgaggaatcgtcagtggcgccaccgttcgtcgcgttcttgctgccaccgaatggcacagcgtcagcattgatatcgggccagtcaccttcactggagttgctggaagcatcggcaggattgtctccggaggatcggaacgcatgcactgcccaaacagccgctgccactaccaatatcagagccacaatgatggcaacgaccttggtcgacagtttgccgaacagatgttcatcgggcagcttgctgtcatcctcgtcatccggcacatccttcggtgtgaagctcggaggaatggcgcttacttcggcaatgcgggcctgctcctcttccaaggcacgcagcgattcctcaccgggggccacagcacggccgctgacatcgaacacgggaatacgactggtcgtctctcccacggtggcatcggaaataccgccggtaacaataggcaccgtcaaccgagtattatcacccggaccgccgatgggggccggattcatttcgctgtaccagtcaccggtgtcttcaccggaaagattctcgtgctcccaggcgtcagaaaggttgaagtcaaacagacggcgggcgtcagattgagactggttgccgtcagcagtactggacccatcaggcagaggagccggtgacatcgcgtgcggagcggggacggcggccggctgaaccggcagggaaggggtaatagacaattccggaagactgctgctgttaatcaacgtgctgggaataggcacgatatcggtctcgttggcgggcttcagtatcgccttggtaatcgagcaatcgctttccatgctcggcaaagcgatatcagcatcgctcagttcagagagctgcttccaattacccaacaaggcgtcgagttctacaagggcagccatcggcaacgtgtgctcgtcgggcttgcttaaggccaatccacgcttgcaaatcacgcggaattcgccaggggtgtcttgcggcaaggcgcgcagattgaatgtgggtgtcgcttggcttggcgtgcgtgtcagcagggcatagagcaatgccgcaagctggcgaatcgcataccgttcaggaccgtccgtacgcagatcggtagcggacgtgtcggccagcatcgtggcacatggtgcatcggcaatctgcacaccggaggtagtcactcgaacggtgtcggttgtgatgacgatgccgctgggagtatccgcaatgacctcgcgcagcacgtcggcgcattctccgataatcgaccggatggcgctgtagctgagcggcttgtcggtatctaccatgtagtcagtcaggcattggccgctgtccaccggcatgacaatgagaagtacgtcggattccatacggtatttcagtacgggaatcacacgatcagggcgagtggcggcgatgcgaccagcgagctcatcgattgcggcgaaagcgctgcgattggtaatgatgaacagctggcaatcctttgccaacacacggtcgttggctttccatgcctgaatgccaggctcctcacgcaacgacgataccaaggtgtatcggttgagaatcgtgtctccgagttgcggtttcatagtgcgttcggctccgtgtgattggtgttcgagactggtcttagatattctacgtgtggggctatccttgacgggctccgtctcaggattgatttgcgtatcgtcgactttttccggctgggctgtcacagcaacgtcctcactggccggagtcttgtgtagacgggccagtatcgagtgataggcgctgatgagttccggggtgcgtatcacccacaacacagccacatatactacggccagcacgatggtgagcaccacgcagatggccagcgcagaccaccagctcatgtgcccgcctactggtcgaatatccgcgtcgaacagtgcgactaccggtcgtttgatcagccagaccacaactccggaagccagcgccgccacaatggccttggcatatgtcctcgtgatctcccgaccgccaagattgccttcgaacttgcggcgcaacatcatcaacgtcagcggcaacgccagtaatccgccgagtgtcaccgagcaggcgatgccgagtacccaatgctcaggaggaagtaccatcatgccgatgatcatgaataccgaggtgaacccatactgcatcaccgcggataggaaggggtgaaggccgtcctcaaaggcgtagaacgtgcgctggatcaacaggaacgccgaccccaatggaatgcccatagacaaggcgataagcgcataggagatcaacatagtctcgtccatcgagacggacggaagcaatgcacggatgatcggttcggggaacacgaccatggcggcggcgaagaacatgatcagcagccctacgttgttcagcgcgctcaccagatcgtgccgtgcctcatccagattcgcagctgcgatggaacgggagatcttggggaacatagccgtggataccgatacggcgatgagcgaatagggcaggatgaacagtgtgtacgcattctgataggtcgcgttgcctgccacgctgaacaggctggcacccgtcagttcgtgggcgcgctgcggtgcggatgtggcgatacgggtaaggataatgccgcagatctcactggtgaccaccacgcccaaagagcctaacgccacgggacccatagacctgagtccaaagccgccaagcccgaagctgggtttgtacttgaacccgatacgggccagcggcaggaacagtatcagcgcttggaaggccacgcccaaagtccaggtgcctgcggtaagcgcgattttgtcggcggtccagaattcgaggggctgttcattggccttgctgaacagcagaataaagccagtaaaaccggcgcaactaataatgttggcaccggttgagctccacgcatacgtgaggaaatggtctttggcggccaggatctgacccaataccgtatacaggccgtagaagaacacctgaggcatgcaccacagggtgaacgaggtggtcagggctatcatctggtgatcgtcgctacccacgtacaggcgggcaagcagagggctggccgccgccatcaccacggtcatggccaataggatgccgatggccaacgtaatcaggcgattcagtcgttcttgggcgtctttttctttcaacgtgcgcacgatctggggcaccagcacggcgttgaagatgccgccggacaccagcgtgaacacggattggggaatcatggaaccggcctgataggcgttggccgccaatccggtggtgccgatggccgcagcgagaagaatcgtgcggagctgaccggtcacacgggaagcagcggttcccgtggccatgatcagggaattacgacctacgcttgaactcattcgtcggggtccttcttccgatggaactgccgccacaggccgataatgcccagtagcacggcgaagccgatgataatgaagccgctggcatcactgatgcgcatcacactggtgatcgcggtgtcctgcgtgttgccgaagctgttgccttcccggtcggtcaacgacacatgggccgtcgatgagccggaagtggaaacgcggatggtgaaggtcacctgagcgtcgctatgcgagggaatatcgatgtcagcggttcgcgaggtgacgatctgcatggagtcagtcagtgagttgacctgcacgctgacggcgtagggaaggtcattgctgacggtgattggcattttcgcggattcgctgaacacggatattgattccgatgggttgatgcgtacgccgttcagaagatcgctggccagtgttttcgcggctttgaccatggcttttcgcgtggctgtcggctggggggagccagacatggaccgcagcgccatatcgtcatgcagcaccagtaaagagccaatccattgcgtcggatcgttgctatgcgaggcggtgtcattggcgtcctgccgggccagggcctgcgggtccaacgacgagacttcgtcggaatcaatctcgttcctcaatatggaggtggccatgcgcatgatgtcatgccggctgtcggccaactgtctcaatgccgaccgggtattggcggtgttggcatcatcggccttgtcgggattgaccgaatcgctgacattgtacggatcggccttggccatggtcttcaggtccgtcagattcaaccaagacgcctgctcgaaggcgctcatcacctgatcgatccagctggcctccgtggtgcgggagaacgtcataagcaggtatcgggatgtatagggctgttccatctggtagaacgcgctctgagcgatcagtcgggccaaccgaccggcatcgctggactcggcctgcgcgtccgtgctggtggcttggcccttggccagcgtgcccaaggtcgattgctccttcagcacggtgacatcgccggcaggcgtatgcaccacgtaggtgcctgtgtgtacggcttcagtctggtcggcatcgaaagaggcatcggcaatcaccgtgtcatagccctgctcgcgtgctgcggtcagcgcatccaacgtccaacagttgttgccctgccatgcgtacgcggagggtgtttcggagtcgtctccgtcggcataccatgcggccgcctgcttggcgttccactgctcagtggtgatgccggccttttcgtaggccgcggtatcacccagcgcggtataggcggtgatgtcgaagtcggcgggctgcatgatgccggcaatggacggttgcactgcggactgacgccaatacagaggatccgcgatcacttgcagcgagcggtgcttggcgaatgtctgcccaagggatcgcgcggtatcggcatcctgctcggataaggatatggcttgcgtatcagtggctttggccgcgttgctggcgtcggcgttatcggacttgtcggccttgtctgtgctgttggacttggacgatgttgatgtcgaggaagtggtggtttcggcaatgcgattgctgatggccttattatcgacctgccagccgctggcggtgtagggcatggccacggtcaggttcatggccggtgttgtcgcggtgttgagcccatccgaagatcgggtcagaaaactcggcaaatcggcgagtatctgattgccaacgatatacgacagcatcagcggtttcggtccccaactccctatggaggcaagggtctgctgattggcgttcacctcgacggtgacggtggcagtgccgccggcgggaatcgatggcacgtcaacggaacccaactcgttgggggtggggatgggggcgttgttctcggcccaattctgaatatcggtgcgcgagacaaaggtgaacaacgcattggtggtcaggtgcagtgtgccgcttgacgtggccgtgctgtccgtattgctgatgaccgcggtgacacgatagcccgatttggaggtgacgatgggggtgctttgcgtgatggcaatgctctgcttgggctgattctcggtctgattgcccgttgcgtccgtcgtatcggatgatgaatcagtcgtgtccgtcgtatcgttcgcgtaggcggtcaatggagcggccagcatcgccacaacggcgacgccagccgccagtgcgtgtgccagacgtgtgtaatgtcgtaagactccgggtaggttcactcgtttgcctgcctgttcttcttcctggcgtagagccacgcgattttgcgttcgttgggatagctcaacacgccatccaaatcttcaaaacgtacccagatggcgtcttccgcctcatgatccgggtctccttccaccgtcaattcgccgccggtctgtttgagcgcgaagtgatggaccagcttatgcacgcgctgcgtggtaccggtgaaccagtagtcgatggtggcgatggaatcgatcacctcgcccaggatgccggtctcttcatgcacttcgcgcacagcggtctgctgcggggtctcgcctttttcgatatgccccttcggcaagcaccattcgagatggccggagcgggaatgacgggcgataatggccacgcggttctggtcatcgaaaatcagaccgcctgccgaatattcgcgtacgaccggcagttcctgggcatccagtgaagcgaatgtggtcggaccgtccgacgtacggcgttgcggcatcatggccggagtcgggccggatggcgtcaccggttctaccggcactgccggttccggcgaggcaacatctccggacgggtgccggccgaagaccgtggccggcgtgggatgcgctgacgttgcgggcctcactggtgctgcagacggcgctgagaccggcatggtgaccggcgttgcggccggtgcggtacgtgccgcaggcggcatcagcacgtcgcgcggagtcggtatcgctgtggtgtgcgcggcggccttggcgaccgcaacggcagcatctacggccgcgtgagcggtcgccgcgggatcgttcgtgacgatggttacggacgtttgtgccgtggcgataatcggctcgacctcggcaatcgtctcggcaccggcctcgccggcgataccatcagcctgcccctcgatagtgccgctggtagtggcgatggtgacggtggcatgcatgccgaagacggtggccggtgtgggcatcatcggcttcggtgcgggcatgtcgctggcggcgtccgatatttcggattcggatggtgcgggtgtggcgggcgttgcgggtgtgccgggtacaccggaatgttgcgcagtcggtactgcgtctacttcgtcttgatgaacggcctgattggtggagtggctcgcggtgccgccggcatcgggagaatcgcccgaatcggcggaatgatgcggagtttcggacgtatacagcaggtggtcttgggtatggctatccgccgaatctggtgtttgccccagcatgcgggcaaggtcggcgggcgtaatcatattctccaccttactcaaccccgtgtgcaggtggggtaacggtatgctggtagggcagaaaaacgtcgcacgcgggaaggtgcccattggatttcgaagtatggcctgaagccatcgaacttggtcgactgttcgccgaacagggttacgagctggcattggtcggcggcccggtcagggatttgctgctccatagaaagagccacgatttggacttctgctcatccgcacggcctgagcagttcgagccgatactgcgccggtgggggcatgacggcttctgggacatggggcgcaagttcggcacgctgggtgccatgcgccgccgcccggacggcaccgaggtcaaggtggaggtcaccacctatcgctctgacacgtacgatccggactcgcgtaagcccgaggtcaattatggcgacacgcttgagggcgacctgtcccgccgcgacttcaccgtcaacgcgatggctctgcgcgtgcccgacctgcaattcgtggacccgttcggtggtgccagtgatctgtccaagggcgtgttgcgcacgccggtggacccgcgacagtcctttgacgacgatccgttgcgtatgatgcgcgccgtgcgattcgtggcccagctgggcttccgtatcgcgccggacgcggccgaggcgattacctcgatgcgcgaccgcatcgacatcgtatccgccgagcgcgtgcgcgacgaactgaccaagctgctgctctccgaccgtccgcgcgccggccttgaggcgttggtcgaatccggtcttgcggacatcgtcttcccggagattccggccctgcaattgcagatcgacgaacaccaccgccacaaggacgtcttcgagcacacgatgattgtgctcgaacgcgcgatcgccctggaaaccggcccggacggcccggtgcccgcccccgacctgacgctgcgcttggccgccgtgatgcacgatatcggcaagccgaagacccgacggttcgagccgggcggcaaagtgagcttccaccaccatgacgcggtgggtgccaaaatgacccgcaagcgtttgaaggcgctgcgttttgaccaccatctggtcgaggacgtctcggaactggtgaatatgcacctgcgcttccacggctatgtggacgagccgtggaccgactcggccgtacgccggtatgtcaaggatgccgggcacctgtacgagcggctgaacaggctcacgcgcgcggacgccaccacacaaaacaagcgcaaggcgatgatcttctcccaggccatggatgagatggaggagcgcgtccgcgaactcaagaagaaagaggacttcgacgcgatccgcccggatctggacggcaacgaaattatggagttgctgggcctggagcccggcccgatgatcggccgcgcctacaagcacatgctggaataccgcttggataacggtccggtggaccacgatgtggccgtcgaagaactcaagcgctggtactccgagattcagtagtccgatagtagtccgataccaaaaaaccgtacgctgaatacgtgtcagcgtacggtttttcgcgaagatgaagctgtatgcgccttactgcgccgtgtatgcgtcgtgtttggtgtcggcgggcagcttggtcatgctatcggcggccttgcaaccctcgatattggtgatggtcttaccggattgtggggaggatttggtgtcctgcagatcgttgaacgtggcgccgatgaccacatcgatgagttgatcctcgcgagccgtcatgatcatggtggcgtcggtgaaattgccgatcagcgtatacgcctgattaatggcgttcttgccgaagtagatggtggtgcgttcaacgccggtgctggaatagttatcgattttctgcacgctgaatccacgattggccaaagcctcacccacggccttggcgaattggccgtgagaggtgccgttcatcacgcggatgccgaccgaagcgttggacacgtattgcgctttgccgctgctgtccttgaccgcgcacggtgccgcgttgccgtaattcggctggcgggccggagtctccacttcgccgaggccgaaaacgtggaaattgaacagtagggctatgaccagcactactgccaataccgcgccgctgatggaaaagacgatggtctggcggtggcgcacgtacgccttgcgggcttcacgttcatcaacctgatacgtcatcggtggacttctttcatgggtcgggtggctggttgctaccttagcgtcactgtctgacgccgatattggggtgtgcgggagatttggctcgaataatgcgatcgaccacagccgtatcgcgccacacatcgataatgcgttgtgccgctgcctcgtcggcggcgaaagcgaccactgaggggccggatccggagacgaatgcatggctggcacccgcctgcgtggcggcgtcgatggcctgcccgctgcggggatgcaggctgattgccgcagcctgcagatgattgcggtcgccttctgcggctcccacgaggtcaaaggtgtggtagacctcaggagtgctgagttgcgactggtacgcgccgaccaatacttcgccgctgaatccctgttctatcagcgccagctcatcgcggctgccggggatgatatccgtgatgcgttcgccgaaaccggtgccgtatgcaaggccaccggtcaggcagaacggcatgtccgcgcccaacgtggcagcaatggtgcgcaggcgctctatgggccagttcagctcccagagacgattgaccgccagcatggtcgccgcggcgtcggctgaaccgccgcctagtccggcacccacgggaatgcgcttggtgatggtcaacgccacatccggctcgcgctcggccgcctgggccatggcgaagagggccagtaccgcatggttgcggcgcatgtcgctgcgtgaggaggccaagtcgcccaaataagcgccttcgagctccagagagaatcctgctccgggttgcttggcggttgcggtgacggtgtcgtatacgccgattgcgcagtagatggtgtccagttcgtggcgtccgccccattcgtcgtgagcaggtcccacttccaaggtgagattggttttcgccgggcaatccaccgtaatggtgatgggggagagctcatcggactgatgtcgggcagcggctgagcgtggatgtgagattaccggactcattgtgcctcatctccatctccacacgattcgatggccttggccagagcggtgaattcggcgatggtgagcgtctctcctcgacgggtcggatcgatgccggcgatggagaatgcctcggagggcgcaatggtcttcaatgccgcgtgcagggtcttgcgacgctgaccgaatgccgcatcgatcagacgaaatacgagttcccgttgtgtgccgtcgtctgtgctgttcgcagttcccggggcagccgggtcatcggcctgataccgggtgaatttgacgagcgcggaatccacattgggagccggccagaacacattgcggccgatggtgcccacccgttcggcggtgccataccaggcgagcttcacgctcggcgtgccgtagatcttggaaccgggcttggcggcgagtctgtcggccacctctttttgcaccatcaccaagaacgagccgaggttgtcgaaacgctccaacagcgtgagcagaatcggcgtggccacgttgtacggcagattggcgaccagcgtaaacgatgcgtcatcgctgaaatcaggcacgttctccggggtgacggttaaggcatcccgattgacgacggtgagtcgtgacgtggcttcgggcatgaattcggcgactgtgcccggcagtcgttcggccagcggcggatcgatttcgactgcggtcatggtggcgccggtttccaaaatcgccagcgtcaacgatcccaggccggggccgacttccatgacatgatcggcagcggtcactcccgcctcgcgtacgatacgacggaccgtgccggggtcgatgacgaagttctgcccgaatttcttggtggggctgatgccggcatcggccgcgatacgacggatatcggcggcacctaacaggtgaccagtggcgggaatggtgtcgttcataagcgtgtgttccttgtgggcttcgtaaccgatcagtaccaaccgacttgttcggaatgttgccatgccttggacgggctgccgtaggcttgtgcgatgtaccacagaccccaatcgatctgtacggcggcatcgtcacggtaattggcaccgaacgcagccattttgtctgctggtagcgactgaggaatgccgtaggcaccggagctcgcgttttcggcataccacagccaactggactcgcgggtccatagtttgaccagacaatcccagtcgttgcctgtccacccgcgctgcgcggcggcaccggcggcataggcctgagcctgggctacggtggcgtgccacaggcggccggagggcgtggtggttgtgcctgaatcggagccagaagagccggaattgttgttcgtaccgccgccggtgttaccagtgttgccggagttgccggtgttaccggtgttgccagtgttaccggaattgccggtgttgccggagttgttgccgccggtgttgccggaattgccggtgttgccggagttgttgccgccggtgttgccggcattgttgttggacgactcgtgctgattgttggaaccggaatcggccttgccgttatcggcggagtcggatttcttatcggaacctttatcggtatcagacttggcggcgcctacggcgatgatctggtcgatggccatcgaggtgacggtctccgatttcagcgtctccgattcggccacgccatccacataggtgacgtcgtacacctgcgtcttctcgccgttgacgccctgctggcgcacatcggcctgcccttcagccagattcgggtcgatgatggtctgggtggagaacggaatcacggacgtgcgcgtcttctcgccgtgggtcacgcggcgtacgcgcagaatggtctcgtcgctgtctttctcaacgctgacgcgatcctccttgttgagcacaatgcccttggaatcgaggatggaggcggccggcagcttgccattgggggccaccgagcttttgccgtcggcgatgacggtgaccggcccggactggttgatcaccaggccgccggtgagctggttgtacacgttcttgatgtcgacggtgatcttcgcggcgttgttctggttttcctcgaaaaatcccagcaactggtcggcgctggtggccacggtccagaacggcacggcggtgccgtcgatgttgatagtggtctggtaggcggactgtacggtgaccacggcatgattggcgagttggtcgccggacgaggtagtgacgatatcgtgggtcttgatatccaccccttgttcctccagaagacgggtggccgtcatcgcatatgtggtgacttgggtggtttgcccgttgatgttcagggctacggatttacgcgcggtgaacgcgaatgatccagccagcgcgatactggtcgccgcgatacaggcgattacgcggatgcgacgcagtgtaacaaaccgctgcggggtccaacgccgtgccattgccatactcttcctgctggatgaacgattacgccacccatcgtaacggttgctccggcccgtactgcggtttcaccggccaccgtcaccattcctgctcgtcagattgttctgagctcaaaaaaagaaaagaaaaagggggcgggagagaaggggatgttcccgccccccctgaaggcgcggagctggttgggggacgctccgccctcattccaggaagcccatagttgggggaaggctcctggagtacttacccaaggtaagaattatatgcgtagaaaagtctacgtatcacataatacgccattttttctgcgcgacgagcctcttgtcgggatcgaaccgacgacctgccgcttacaaggcggccgctctggccatctgagctaaagaggcgattgttcttaacgcgtaaatcgttgcgaacaaatgactagtataccggtacttcccgagtggtcaatttaagccgagccgcaggcggtattgcatatgtcgcggcgtcaacttattcggccacgcagcatcaggaggcgaccgaaatcggctttccgctggcaccgatggatggcattttgccttccacgcctacctggtcagcatccagcccaatggacttgaggaagccgtccaccatattcgtgtccgccagcgtgagctgcttcagatcccagtattcgccgttgatggtgagtgtgggggaggagaaggcgccggagctgttgaacagttcggggcgcaggatcgtgtagttgttggaggcggtgagccagtcgaggtattcgttcttgccgctgaacgccgcggcggccacatcctcgctcacgccggccttgacggcctgcttctccagcttggcgttgtttaccggctcgtaattggacaattcgcccggctggaaatcctcagcgtagatgttggagaggtagctcatgaggtggtcgggatcgtcatcatgctcggcaatgtagatggcaccgttgaacacgcggttggagtagttgtcggagctcttgttgttctggaaattgaggaagtgcaaatcgatgttgagctggcctgcgttcatcagcttgacgagcgtcgggtcgagttggcggttcaccgaggcgcagccggggcacagcggttccatgtagatggatacggtgggagccccctcggctttctggccataccctttgttggagattacgaagccggccttgtcgtcggcgttagccggctgggtactgactttcttgagcttgctataggcctcgtccacggtcatgttgctttgctggctactgctgctggtgttggacggccgcatagccttgtatacggcgaatccagcgatggccaccagcaccacaataatggccaccacaatgcagccgatgatggtctgctgcttacgctccttggctgcctgctcggcccgtgcctgttgtgcggcctcctcggccgctcggcgctcagcgcgtgtggcacgcttggcctgacgcttcggatctgacatagctatccccttgcaatcgcttcaatgtttgggccccatcataatgaccgggcctgaggaggactgcgcccagagctgatctgaggtgaattccctgtaaaagtgtgacggaacgaacgtatcggatacacaacggccatgtgtgcggatggctgatgtgtgagattccgccccgctctaggcgaacggcatccagttgatcggcatgcccagaatcggcatcgcgcacaaggccacggtgatgatggcccatatggtgaacagcacggtgccgcgcccgccgcccttgggcgccggcgccactggagcaggtggagccccacccacttcggtggatggcgcgcccgccgggcgactgtgtttgagcccgcgcagtacgccgccccccagccgaatcatcatcgactgtggggcgaacacagtgaccagccagccgatggccatgaaaccgcccagcgccagcccggaagcggagaacggcacatcattgagcaacggcaccggaataccccaatccgcggtgaaataccaggagatggtgtgaacgggcagtgccagagccgcggtggccacggcggttcccgccatatagatgatgactagcagcagtatgcggggaatggccagcagcagggctttgaccagatgccagggaaaagtcgccacgcgaatccacgaatcggagtttttgcgctcgccgccgcgtttgccctcgcgctcaagctggggttcggtgttataggccagggtgagcagtagccacaacaacgcggtggccgcgatgatggccacgagcggagcatttgccgccagtgccgccagcggcgccgccagcaggatcaatggcagggtgccgcgctgcagatattcccctcgcttcacgtccaccggattgggcatgggaggattttggaccatggtttcggtgggggccgcttgggcggtttggtcgatgatgcgctgcaatgccgggcgaatggcggggtccaccgctgtgggctggttgcttgcgggatcccagctgctctgggcggtgccggacggggggaatgatgacggctgcggcgtggggagtacggtggtgcgctcggccagcggcgtggcctgctccgcaccggccggcggacgtggcggcatatcggctaagggcagcgtggcggtagcggcgccagccggcgagaatacggcggtttcgccatcgccgttatcgcccttattgccggagaacacggccatggtgggagcctcagcggcttcctcggccgcgcgccagatggttcggggattattgcggtcaacgccgccggccgcgccaaaagggggcatcgcctccgcggcttcggcaacgatcgcagccggttgcccagccacggctcccgcggcgaacggtcccgcctgctcgccctgccaagcgttgggattcaacgcatccaaggcgatggcattcagcaattgatccggcgtgcaacgatccctgcgatccgggtccagtgcagaacggaaggcagccaatgtgccggccggtagtccggaaagattcgcgttgcccgaggcctcgcgctcaagtaccgccatcatcggcttggtgccgaacacaggcgcgccggttgcggcaaaagcgagcacggacgccaccgaccaccaatcggtggcgtcgtcggattcggcaccgtcaataatctcgggtgcgatgaatccgggtgtacccatcactaggccggtgcgggtcacgtgactttcgccctcgcccatcgcgataccgaaatcgaccaataccggtccggcggccgacaccatcacattggtgggtttgatgtcgcgatggacgatgccggccgcatgtacggctttggtggcttcgatgagcttgcgggccaagcgttccagatcgtcgcccacataccggccattggcggccacatcatccttaagattcttgccctcgatgagttcagtgacgatgaacgccaacgtatcgtcgagttccatatccacgatgccgcacacacccggatgattgaccttcttcaaggccatggcctcgcgccgcaggcgctcgcgcggcgtgacatcgggcttgaggtcggggtcgtgcagggccgtggacgcagagccggagcctgccactgactcgtcggtcagggagtcgcgcagaatcttcatggcataggtggtgccgccgtcgtcgcgcacccgccacaccgaccccatagctcctgagccgagccgggagatcagcgtatacccaccaaccacttcgccgggctcaagattcaacgcgttcaaatcgctcatgccctccatcctaatgccttgccggtgcattattctggctctctcctgggaggccgagcttgatatttcttggctcccctctctgagaggggagccaaggataaatgccgtttacgtattgagaagtgccgtttacgtattgagaagtgccgtttacgccattaaggtcgattgccctgaccggatgtggtagcaaattatgcgctcgaaatgacaggataggtgcgtgggcaggtgcgccagtcgtgaatttgcgactctataaccatcggcatcaaggatgtgtcggcggtgacccaaaggtgagccagccgggcacattcaacagtggcacagcgatgcaagggcagtatcgtgagccgctgatcgaatcgataacgatatcagattcgaatgccgcgacttcgccggtcgtaccttcgaatacttctccgaagacggctacctgttcggcgtgatggcctcccagcaggtcgctggcgctcaggccaagggcgtgtacgccttcatgaagcacttcgcgctgaacgaccaggagaccaaccgactgagcgagctcgccacctgggccaacgagcagtcgattcgcgagatctacctgaagcccttcgagatgagcgtcaagcagggcggcgcgggtgccgtgatgagcgccttcaactacatcggtatggagtggggcggttcccactccggactgctcaacactgtcctgcgtggcgagtggggcttccgcggcatggtcctgaccatcatgaagtacctcaagcgccgcaaactggccgcggcggcatcggctcccgctgacgctccggtcaaggcctgaggtgtgtctccgataactgaatagctaaatagaatggacggcctgctgagcgctactcaacaggccgtccattgtgtatctgaatgcgaaaagtcattatatggaacggaatatatcgatactgtgcattgtgccgattactgattccgacgcaagtattcgcgcaggaagggcacggcaaaatcgacttcgcctcgttctgtttcgcggataacgaaggcgtcaaggaggcgtttgcggtaggtggcggcatagttaggcgttttgcccatgcgctgtgcaacattcacggtgggagagggaccatctgacgctgccatggcttcgagatactcacggtcgtttttggataagccttgcaactccgggatgcacacggcgttatcaaggtcaatacgtgcttcctcgatacctgccgtaacatcagcgtcgatgatggtatccgagtcccgcatgtctgcggcatcccagatatggtagccaaccagttgaatcatataggggtatccggctgtcacattggctgcagtgcttaattgagcgtcggtgatggacatgccggaggcgcggaatgttgtggcgaaagcatcgcgcacttcatcaagaggaatatctgtgagtatgttcgttttcgcgcgacgtaggaacgtgatgacttcgtcattgaacaaatcagaaatcatctgtgggagaccggcgaacacgatggcgatattgcgtcgttccctgatttgatgctgtatggcagtggcgatggcaatcatgtcggatcgctcagccgcttgagtctcatcaatggtgataagcaacccagcatggcgcttctcaagcgcatccaaccgtccggcaatggcacttctcaacgtttcgggcatacgcttcggggatagttcggcttctccgaggccgatgcccgctccagcaaaagtcaacgatggtcggatagtgaggtggtcaagggcccctcgcccggttcgtaaggcatcaacaaggcgttcgcatagtccggcagaggccgtttcttcgatgacatcccatctgcgcgctttggcccggtctccgaacacagtgagcatcacggtttttccggttccacgagcgccggtgacgagcataatgcgccctggggcaccgactccgttatcgagacctttctcgaaatcgcggataactttgcctcggccgatgagcaggggcggttcccctcctgccgttggcttgaatgggttttcctttgccttcatgtggaccgcctcctcgctgaatcaacctaaaataaaaattatcaaaaatatcaaaaaaataaaaattatcaaaagctgggttgagccgactgaagaaaacagccgtggcgacaatgatcctgccgcaatccgcggtgacaacaactgacgcggaccttcttggcagaatcgttgtttgtcccgcttcgccaatcaacgtcgctcaagttcggtgcgcagaccggctaccgtagcggtcagctcacgcacttcctcgcgcaataggtcgatttcgggattggctgatgtcgcaatagcctcttgcgcggcttccttggccacttccttctcccgagcgtcctcgcgccgatccgtctccagattgacctgatccacgatccacgaggccagcgtggccgtcacaataccgatcaacgcgatgccggtgaacatcagcaccaccgcaatgatcttgccttggaaggtgaccggcgagaagtcgccatatcccacggtggtcacggtcacgaacgcccaccacaacgccgtgccgaagtcggtgatcgtggatccggacgcctcgcgctccacggaatacacggccagcgcgcccacgtacatgagcattcccaccgcgccgaccgcgtatacggtgatgcgcccgcgcaccgccatgccggaggtgcggttcagcacgtgcagcacggtcagcaaacgcaacagtcgcaagggccggagcatcggcagcgcgatggtcagcagcgtgaacaggttgtgcttgaaccaccgccagcgatcgtcggccaaccacagcgagaccacataatcgacgacgaacaccacccagatcacgttgatgacggtttcacacagcgcgatatgcgtgcgggagagaatttcccacgaatacaccaccagaaacaccacggacagcaccatcagcggccagtccgtccacttcttccacgtcttcagtcccatattccgattgtagtggcgcgcccgctgcgccactgcggagcatgactccggacgtcagtgttgtatacgttcgtatacatttcacgttgtgtacgaacgtatacagcggtatctttcatctcgcatttcccttatgactatcaccacagtgatataatcaagaatatgtaaggagagagagaaggagccggccaatggagaccgcatcgatcgaactgtggcatggctcttcgcatgtcatcaagcatcctgaatacgggctggtcaagccgaacaacgattatggccgcggattctattgcacgcgcagcgtcgagctggccaaggaatgggcgtgcgcgggactggatgacggtttcgcgaatcggtacacgttgaccacggacgggctcctcttcctggacctgtcccagccgccctacaccatcctgaactggctggccatgctggtcgaaaaccgtcgtttccagccgaccaccgccgtcgccgcgcaaggcatcgaatatctgaaacaagtgtttctgccggatgccagtcaggctgacgtcatcgtcggatatcgtgccgacgattcgtatttctcgttcgcccgcgcttttgtcaataacgcgatttccatcgaccaactcgctgaggcgatgcggttgggcgagctcggcaagcagatcgtactcgccagtcctcaggcattcgcggcactgcggttccaaggctgcgaaatcgcccgcgcttcgacctaccacgtattgcgcaacgagcgcgaccgcacggctcgtgaagcctaccgtcgcaacagcgctgaagccgatctcgacggcctgttcatgcgcgacatcatccgtgagaaagtgaccaacgatgatcaccgcctacgatgagacatacttgccggacgccatggccaacttggccggcgccttcgattatgcgctgaacgattgcgggttgccggtcggcctattcatggacttcttcgccacctccgaggcggccgcgcttttcgggcgaggcacgcctaaatacgtgtgtggcatgtccggcgaggagctggtggccgaaatcatgcggcaaaccggttgggcgcgcattctcgatatgccgccagccgcactgcgcgccggctcaacacccgaatactgggccggatgggtactcgcatactgccaatggaccaggggagtgcggttctcggacattctcgatgtgctgtcgctcgacgatatcgtgcgactgcacccgactctgcacgaagccgacgaaagccgattcgtcgacgtgtacgacgagcgggccgcccataatcgcaccgagggcgactcccggctgcacacgatccgcgtgcgcgccggactcagccaatccgggctggcccgccgctccggcgttaccctgcgctccatccaaatgtacgagcagcgccgcaaagaccttggcaaagctgccgtctccaccgtgctcgctttggcccgcacgcttggctgccgcatcgaagatctgttggagccgtaaagacgcggagtagtatcgcgccgcatcgattctgataactgaacaactacttttaaggcccggccggatgctcgtttggacatccggccgggccttctggctccacacggggtgccgaggtatccgttctccgcttcgaggggctgatttggccttccgtagaggtttactcccgtttcgaggggctggtggcccgctagaacacgggtataaacggcttcgccccaccgtcattccgccattttggggatgcgcttacttgagtaccagcccctcgaaacggagatagatctccggaaagggtcaaaacagcccctcgaaactcaagatggcggttgcagggcggttgaggatcagtcgaagagcggttcaaacgcaaatgtgaacaatgccacatgtgattgggcgggtcgctgcacgccgattttcgggggtgcatgggaatggcggaatatcaatgaaaaaccctatatctaggtttgttatgtgacacgcgccactacatatagtgccttgatttcaaatcacaccgctgtaatatggccttcgcttcactgttcatcagaaccacatcaaggggagtcgccatgaccgtcaccgtgttcaccaagccgcattgcccgcagtgcgatgccaccaagcgccagctcaccaagctgggtgtgccgtttgaaaccgtggacctgacgcagaacccctccacccttgagcagctgcaggccgccggtttccagcaggctccggtggtcatcacgccggacaactcctggaccggctaccgccccgacctgattcgcgaagtcgcccagcaggtggccgccgacaaccgcgccgccgccacggtgtccgcgtgagtctgagccagcccgaattcgcggccgaaggcaagacgatcggcgcattggtctacttctcgtcggcctccgaaaacaccgcacggttcgtggccggatgccgtttgcaggacgaaggcatcaacgtctaccgcatcccgttgcgggccgccgacccggcgctaaacgtccgcgaaccgtacgtcatcatggtgcccacctatggcggcggcgtggtcaagaaagcagtgccgattcaggtcaaacgcttcctcaacgatccagccaaccgcgagtggattcgcggcgtcatcgcctcaggcaacaccaatttcggtgaggcctactgtgccgccggagacatcatcgccgccaaatgcaaggtgccctacctctaccgttacgaactcatgggcaccccggaagacactgccgccgtgcgaaacggcctcgtccgcttcttcaccgaacagtaaatcttgaccccctcgaggtattggctcccctctccgaggggagctgtcaacgaagttgactgggggagcaactgtctgagtaaacacacttctgccatattccaaggatttccaatgactgacctcaccgccaccggcctgccgctcgacaatactgccgacaccgcagcggaacagtacgacccggcgcacgattaccacgcgctcaacgcgatgctcaacctctatgacgccgacggcaagatccagttcgacaaagacaaggccgccgaacgcgaatacgtgacagggcacgtggccaccaacagcaagcggttcgcctccaccgccgagcgtctcgaatacctgatcagcaaccagtactacaaccctgcggtcttcaaccagtactccgctgaattcctcgaccgcatctacgagcacgtggaatccgccggctttgagttcggcactttccttggtgcgttcaagttctacacgtcctacgcgctcaagacgttcgatggtcgcctctatcttgaggacttcccgcagcgttgcgccgctgtggccctggagctcgccgccggcaatgagcagcaggccatcgaatacgccgacgaaatgcttgccggccgcttccagcccgccaccccgaccttcctgaacctcggcaaggcccagcgtggcgaaccggtcagctgcttcctggtgcgcatcgaagacaacatggagtcgatttcgcgcggcatcaacgcggccctccagctctccaagcgcggcggtggcgtggccctgctgctgagcaacctgcgcgagctcggcgccccgatcaagcacatcgagaaccagtccagcggcgtgattccggtcatgaagctgctggaggactccttctcctatgccaaccagctcggcgcacgtcagggcgcgggcgcggtgtacctcaacgcccaccaccctgatatcctgcgcttcctggataccaagcgagagaacgcggacgagaagatccgcatcaagtcgctggctcttggcgtggtgattccggacatcacgttcgaactggccaaacagaaggcccagatggccctgttcagcccgtacgacgtggagcgcgtgtacggcaagccgttcgccgacatctccgttaccgagcattatgacgagatggtggccgacgaccgcatcaagaagacctacatcgacgcccgtaagttcttcaccaccatcgccgaactgcagttcgaatccggctacccgtacatcgtgttcgaggacacggtcaaccgcgcgaacccgatcgaaggtcgcgtgaccatgtccaacctgtgctcggaaatcctgcaggttcaggagccgagcgcatacaacgaggacctcacgtatgcgcatgtcggccgcgacatctcctgcaatctgggttcgctcaacatcgctaaggcgatggatggcggcttgggccacacggtggagacggcgatccgcgcactcacctcggtggccgagcacaccagcatcaacgcggtgccttcgattcgccgcgccaatgaggagggccacgccatcggtctcggccagatgaacctgcacggcttcctggcccgcgaaggcatccagtacggttctgaagagggcctcgacttcaccgacatgtacttcatgaccgtggcctaccacgcctaccgtgcctcgcacgcgctcgccgtggagcatggccgcacgttcgccagcttcgctacgagcgactacgccaagccggccggccagggcaactacttcgacaagtacaccgatggtcgtcgttcgctcactccgcgcaccgaacgggtccgtgcgctgttcgaacagtacggcatcgcgatcccgactgcggccgactgggaggccctgcgcgacgcgattctgaaggacggcatctacaaccagaacctgcaggccgtgccgcccaccggctcgatctcgtacatcaaccattccacgagctcgattcacccgatcgcctccaagatcgagattcgcaaggaaggcaagatcgggcgcgtgtactacccggccgcctacatgaccaacgacaacctcgggtactacaaggacgcctacgagatcggctggaagaccatcgtcgacacgtacgccgaggccacccagcacgtggatcagggactgtcgctgacgctgttcttcccggacaccgccaccacccgcgacctcaataaggcccagatctacgcctggcgcaagggcatcaaaaccctctactacatccgcatccgccagcaagccctggaaggcactgaagtccaaggctgcgtctcctgcatgctctgatcgttcgagggagcgtataccgcctttcttcggcactcgacgtaccttcgtacgccttcggcctcagacggcggtctccgcacgcattgaacaaccagagagccgttgttactcccctcactcggctaacgccgacagctcccctcagagaggggagctggccgcgaagcggactgaggggggctccaccatctaaggaaccaacaatgtcacgaaccgtctatagagcactgctccggctgaccgcgccggaggagttcgaaaacaaatccaacgacgataacgacaacgagtaaaaggaacactactcatggcaccgatttccattccgcgcaaaccgctgaaactcatcgaccgcgtctccgcaatcaactggaaccgcctcgaagatgagaaagaccttgaggtctgggaccgcctgaccggcaacttctggctgcccgaaaaagtccccgtctctaacgacatccccagctggcagaagatgaccgaggacgagcacacgctcaccatgcacgtgttcaccggcctgaccctgcttgacaccatccagggtacggtcggcgccgtctccctgattccggacgcgctcaccccgcacgaggaggccgtgtacaccaacatcgccttcatggaatccgtgcacgccaaaagctactcgtccatcttctccaccctgtgctccaccgaacagatcgacgcggccttcgactggagcgagaacaacgagttcctgcagaaaaaggcggaaatcgtgctcgactactacgagggcgacaacccgtacaagcgcaaggtggcctccaccctgctcgaatcgttcctcttctactccggcttctatctgccgatgtacttctccgcgcacgccaagctgacgaacaccgccgacgtgattcgtctgattatccgcgatgaggccgtccacggctactacatcggctacaagtaccagaagggcatcgcccagctgagcgatgccgagcgcctggatctgcaggactacacgtacgacctgctcaacgagctgtacgacaacgaggtggagtacacccagtcgctgtacgatcgcgtgggcctgaccgatgacgtcgagaagttcctgcgctacaacggcaacaaggcgctgatgaacctcggttacccggctttgttcccggctgagatttgcgatgtgaaccccgcgatcctggccgccctgagcccgaacgccgacgaaaaccacgacttcttctccggctccggctcctcctacgtgatgggcaaagccgaagaaaccgatgacgacgactgggacttctaagggtttcgcggtccgcgaacccgcagcgccgccgcgttcgcacggcggcgctacgctggagatatggaacaggagccgttggtcagcatcatcatcccggtatataaggtcgagaagttcctcgacgaatgcgtggcgtctgttgccgcgcagacgtacgccaatctggagattctgctggtcgacgacggctcgcccgacaattgcccggccatgtgcgacgcctgggccgcccgcgacccgcgcatacgcgtgattcacaagcccaacggcggcctgtccgacgcccgcaactccggtatcgctgaggctatcggcgcgtacatatacttcgccgattccgacgacaccgtggcacccacgttggtggaggactgcctgaacgccatgcgcgagtatgacgccgacctcgtgatgttccagttcgacaccatctccgagaacaacaagccgctgctgtccaactatcgccacaacgacttcaccgaggtgcaggtcctgaccccggtcgaggtcatcaaaaagcaagtcaaggctgagattgacggctatttctgggccttcctggcacccgcctccacctatcagggcaccggattctccttcccggtgggtcgcaaaatcgaggatctctcccgtatctgcaacgtgatcggcgaggccacgcgcgtggtccgtctgcccaaggcgctgtaccactaccgcatgcgcgagggatcgattaccgccaactgggatccgcagctcacccgcgactggacccgcgccgccgacgaccgcgaggaatacatcgtccaccgattccccgagctcaagggcttcatgacgctgcaacagctgaatttttttgccaacctcgattacgagaccatgcgccagtcgctgatcgccgggctcaagatcgatcccgaggacgccgacgcgcttcgtcgccgcatcgagggcctgaccaagtccgccgatgagggcgatgagcccgtaccggaaacgttgcgtgagttgctcggactgctcaagctgggcatcgccaaggtggccgatggcacgttcggtaaggccgatggcagcagtactgatggcgatgccgagaacgatgacgtaacgctggccgaccgtttccgcgacatgcgcgaggactggcgccagctgcgcatccagcgcatcgaagacgccgaggagcgcaaggccgagcgcaaagccgcccgcaacggcgtcaccttcgagtctgtgtcgcattagtcggcgactgatggaatccatcagtccgggaagagcagacctgctctacgtcgggcgtgccggttcgcacgttcgagaaacaggcgtgtcatgggccgaaccacacaacacccccagaaacgcccataaagttaactacatttcagacacgccacttcccgatgtctatttagaagtgcaacacccttgttggtcctgtaattctaacagttcgccacggtcttcgtttcggtggcttctggtcacctgaccctccttgcggtaggtcaggtgttgcaacgatcactagaacccgcctcgctgaaagcgactggggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacttggcccgcgctcgctaccgtgtgctgattcttgaaaaagatgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagacgttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccgaccgtgcgcatctgcgtgccggctgagggcgacggcaaggccggcaaggacggcaatggttcactggtcttcaccggtctggccttccacggcgtaccttccggccatgagttcaactcgttcgtgctcggcctgtacaacgcggccggtcccggccagccgctgggcgacgacctgatcgaacgcgcgaagtccatcacagacccgctgaacatcatgatcctcgtctcgctcacctgcacgatgtgtccggaaaccgtgcttgcttcccagcgcattgcctccctgagcccggccgtgcgcgccgaagcctacgacgtctcgcacttccccgaactcaaggaccagtacggcgcgatgagcgtgccctgcatcgtcatcacccacgccgacggcacccagcaagttgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacaacgaacaggccggtgagcaccgggatgagtgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccccgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcagcgcgtgcgtgacgccgcccgcaaactcggctacaaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagtgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgtgagtctactgcggcgtgaaatggcgtgaaacagggaagtcccactctggcgagtgggactttaccgatatgcgcgggtaaaaggaaacccccgctgagtcgcgggggttgctgtgctgcgatatgttttgcgcgcgcaaagctattgcgcaaaacatatcgctacgttttggccttgggaagcccaccgggcttcccaagcggtgttgggccgcacgcgcggcccaacaccggccaaaacgtcagcctgtgttctgcaggccagcggcgacacctgaaacggtgcagaggatcagatagatgaaccctgcctgctggctttgcgagagctcttccttgtccaccttcttgcgcagcgacttgagcgccagcacctgagtgacggacagggcgtccacgtacggagagcggatgcggatggcctgaccgagcacgtgacggtgctgcagcggccacttgtcgccgacgatgtcgagcacccacttgcgggtgagctccatctcgttcagcaccttctcgttgaggtcctcgcggtcgccgagggcgaggtacatcttggcgatgcgctcgtccgtcttggcgatggacatctcgatgttgtcgatgaaggtggagaacagcggccattcctcatacgccttgcgcatggtctccagatcgccgaacttctcgcatgcggtgccgagaccgtaccaggcggccaggttgatgcgggcctgagcccaggagaagatccacggaatcgtacgcaggtcgtcgagcgacttggcgccgaggccacgcttggccgggcgggagccgatcggcagcaggccgatttcggtcagcggcgtgacgatcgagaaccacggggcgaagccatcggtgttcaacaggtcgaggaagcggttgtgcgcggcctcgtcgagctgagcggccatatcggcgtacttctcggtcatctcggtgttgcgcttctccacgctcggcgcggactgcagcaaggtcgccgcagccacggactcgacgtggcggatggccagcaccgggttgccgtagcgggcgaagatgacctcgccctgctcggtgagcttgaagcggcacttgacggaaccgaccggctgggcgagcaccgcgcggttggcggggccgccgccacgaccgacggcgccgccgcggccatggaacagggtcaggtcgatgtcgtgcgactcagcccacttggcgatgcgctcctgagcggagtgcagggccagcgtggcggaggtcgggccggcgtccttcgaggagtcggagtagccgagcatgacctcgagcttgttgccggtggccttcagacgagcctgaacctcggggatcttgatcatttcctcgagcacgtccaccgagttctgcagatcctcaagctgctcgaacagcgggatcacgtcgatggtgggcacgtcctccgggtgggagaaggccaagcggttgagctcgtagacatccttgatgttctgggcactcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctgcaccaccttgagatcgttgaggaagtcgtcgcaggagtggtacatgaggtcggcatcgcgctcgatggtgtagtgcagacggtctgccatcaccagcatgaccgcgcggtgcatctccttggtggagatcagggcggccttgtcggtcagacgctcgctcatttccttctggtggctccagaggttcttgagctcggcgctcggcggcgtggtctcggcttccatcgtgaggttgcggccgacggtgcgggtggcttgctcaagggcggcgatcacgtgatcggagaacttgcgggccacggcgcggctcaccttggcggtgacgttcgggttgccgtcgcggtcggaaccgatccagctgcccgggtggaagaacgcggggcaagcgggctcgacgagaccggccttatcgcccaggacccagtcgtcgaagcgacggtaaaccttggggatggtgttgaacagcgtgttgtcgaagatgtcgagaattgtgtccgcttcctcaaccggggtcggcttcttcagcgcgattggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttaagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggccgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgttcctggcgggcattctggcatcggcgtggcgttcatccgtgcgacgtggctggctaccgccgcacctcggctacccgcgcatctgcctgaccgtgccgtcgatcgtgatcatggtgcccggtctgtatatgtaccgtgccatgtggtacctcggcagcttccagaccatgaatgcgctggactgggcgttccgtgcgttcatggtgattatctgtctgccgatcggtttggcgatggcccgcgtggtgaccgacaagtcctggcgctacgacatctgaccgtcatcttggctcccctcaggtggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacgcatatcagcacatagttcctgccatggcggtagccgcttggcatcatgattggggaggggtcgcagttggccaacgatttctggattctgctggccatggtcatctattttgcggccatgctgtccatcggattcatctactccaaacgctccaactcctcctccaaggaatacttcgcgggcgggcgcggcgtggggccgtggctcacggccctgagcgccgaagcctccgacatgagcggatggctgctgatgggcctgccgggcctggcctacttcaccggcgcggccgacccgatgtggaccgccatcggcctggcgctcggcacctatctcaactggaagcttgtggcccggcgactgcgccgctactcggtagtggccggcgatgccatcaccattcctgacttcttcgccaagcgtttccatgacaagaagggcgtggtctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtccgtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgatcgtggccagggtcacgctggtggtcatgttcctgttcggcattctggtggcatacgaccagaactcgtcgatcttccaggtggtgtcttacgcgtgggccggacttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgccgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccctaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcgacgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttagttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactacgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagtttaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggtcaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggtaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtggactgcatgcatattcctacacaacgggagattcgataccagtgggagcgcggtggtccggtgatgacctgggcgctgattgttgcgtgcgtggcagtgtggctactggaggtattgctgggatttattgccccgggcctgaggacttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaagaacaacctaacgatagaaaaaacgatctaccgatagataagcgcaacgagccggaactcagcgccatcccatcgtcatcaggaatccgatcatgatcagggcgaaaccgatgccgaggttccacgcaccgatgtttggaatcggccaggagccggacggggagaggtagtacaccacgcaccaaatcaggccgatgatcataagcgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggcttaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttcccgggattgttgcgctgggatagctctttatacagcaaaagggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtacggcaaacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccctgacccgtggagtagctcacaccgaaatcggtgattttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctgtggaacaggtccgccaacgatttcgaggggacgtattccataatcagaaagccgatgccgtcatgctcgtagtattcgaacaacgcagcgatattcggatgcgccagattggcggaattatgggcttcggcacgcagacggcgtagcttggcctcggcgttggtcatgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtgtacatctgtgttatgcaccaacaccgcgacggcgatttgcggatcgtccgccggcgcgaaaccgatcacccagccgtcgatggcagagttgtcgataccgatttgtgcggtaccggttttggccgccaccttgatgccgtcgatggccagctgcggattggcctcggacaccacgctttccatcatcgtggtgagcttgtctacggaatccttgctgaacgcattggccatggtctgcggcttggtctgcgaaagcacggtgagatcggcggcgcgcacacgatcgaccagcgtgggctgcatcagtttgccgttgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcgcccggtgcctcgtcgttcggcaactgtgtggcggttcccggcaaggtatagctggcgcccgcaggaatcttcgtgtccgtctgataatcgccggtttccagcgcagccgaggcgacgatgatcttgaacgtggaccctggtgggtacagctgcgaggtggcgcggttgattagagggctattttggcccgcagaaagttcgttgtaggcctgagacgcggctttggtgtcatgggtcgccagtttgttcggatcataactgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgattcgtagtgccggtgagcatggccttggcccgctgccagatcaatgaatcggcctcaccgttgagcagcatgctgcgggaggcttccaggccgcgatcggcggtctggttgatggagaagaagccggtgaccggagcatacagaggaccgttggaataggtgcgcaggtatttgaacgcgtcgttgaccggttcggatttggccatgaccgtgccgtccgaggccagaatggcaccgcggtaggcaccgagctggtggtacagcgaacgggtgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtgccggtaggcgtgtacggttcatcggcttcggcatacgacggagtggtggtatccacgatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatggtcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcgatgcgggcgatcatggtcacgccggtggcggtcagcagtagcacgcaaggcagaatcgactggctggcgtacggctggaagcgcacaatcagcccccacagcaccagaaacagcactacgaccaatgccagcatgccggcgtattgcatagggaattcgccggcggtgcgctggaacatctggatgaacgccaacgcactgattgccatggcaatcagcaacaaagaaatctgacgtagacgggtaacgatcattgagaatctcccgtggccgcgttgtcggccgctccgataccggatttatccgaggaatcggatgagcttgacgaaccggacttgtctgatgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgcggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcagatcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagcagccaacggtcggcggggtgggctcggcgaatcgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggtgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtctccatcatgcgggagatcgtctcgacgttgccaccggtgtcatcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtattcgaggcggcgcggccaagcgtgatgtcggcttcggccagcggcacggagctgccggcaagtggaccatcgatgatgaccaacagggtaggccccgccgaggcggcggacgacgcggaagcgctgggctggcgatgcgggcgcggcgcagctgcctgcggcgtttcggccttggccttatgcgcttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccagatgcttgcgggagatgcccggatcgtcgatgacgatatcgcaaccggaaccgcggccgattaccgtcttgtccttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccagggcgctggaaagatcgacaggctgcaggtctttggagccaaacttggcgaatactccgttgactgcaccttccacgcttttttcaaaacggtcgagaacgctcatagtcctccctttctaatcttcacccatcctacgcggtgatgggaatatgagacaaaaaaccggtctttcacatgacgatgagtgcaaaatttccaaaaattcagggcggaaatgggtgcggcgcaccacccgaggtgctttaccggtggagcacctcgggtgggatgcgcgtgttatcgatctgtcaggccagcgcgtcgcgcaggaaatcgcgctggagggtgagcaggttttcggccacggtctcgtcgttggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgttgcggtagtagacatccgggtcgaggcccagatagcgctcggtgtagtgcgtgtcgtacagcgtccagtcggtgggcggggcgccggcgcacgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccgcatcggcgttcaaccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaatccctggtcggcccaccactgtccctcccagtagaaggactgcgaggcgatgacctgctggaagccgggcccgccgtacggcttcatcagcacaggcagcttctcggcgtgcgcgtacgggctttccgggctcggcgcgatgatcgccgtgtacagctggtgctcgcccagtcgcgtaaacgtgacgttcggcgtgaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgaaggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccgacccgctttagatggcgggagagccatggaattatgggcataatgtcttctctccgccgccgcgccgccgtggttgcggccgcggtatgcgccggcgcgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggatcacgacgccgtctggcctgcctcctcgatgtggatttcgatgggagacaccaagcacatcgtcaaagacgcggccagcacctccaccacgccgatcgtgttcggcatcgccaaatccaaggccgtcaaactcggctgggctgacgacaccggcgccaccaagcccgtctccaccgcggacatcctcgccgcggtcagcgacggcaaactcacgttctccatgacctccgccacggtgatcgacagcgcgctcaacgtctaccagaccgcgctcaggaaacccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagattgagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggtacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcgcccagtcagactccatctggtggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgccggccatgatggatacggaccggaaaggcatgggttacctgttcccctcctcgctcgcggccgtcgaatacggcaatgcgaaaggcgtcaaggccccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacctgggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaaggacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggctctcgacctgcagaacaaggccgacgaagtgaccaacaagctgctggcgcgtaacgcggccgccctgcacaagggtgcagtggacgcggaaaaggccaaccagcgttccgtggtggaaatcgacacgctggagaagatcaacgccgaactcgtcgccaccctgaaggagaccgtgcagatccagaaggaaggcaaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcaaccattcccgccgcaatttctctgtgggcataatcccggaatgattgccgcgctcgggaattgggtgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgaccaccgatgtgcgcgagaccgacaagggttacgacgtcgacatcgacatgcctggctttaagaaggaagatatcaaccttgagctcaacaacggctatctgaccgtgtccgcctcgcgttgcagcgagcatgaggacaaggctccggccgctgaggacgaggcttccgacagcaagtgcgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagcttcgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcatttggctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccgttccggcggccacgtcgtatccgcgcgcgccacgaccatcggcctgatggcaatcctgctgtggagcttcatggccggcaccgtgcgcatcgtctccgaaaacttcggcgccacgcttggctcggccctgatttacacggtcggcggcatcctgctgctgatgttccggcgcccggccccgattcgcgagttccccaagaaatacctgattatcggcggcctgttgttcgtattttacgaatcgtcgatatccctctcgctggggctggcctctaccgacgcatcctcggtggaagtgagcctggtcaactatctgtggcccacgatgatggtgctgctgtcggcgagcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggtggtggttatgcctgctggggctatggcattctgcatgggtctatggagcggctggctattgcgtcctatgccacgccggtgctgtccaccggggccagtgcggtgttgctgggtttggcgctgtcgctgccgttttggtgtggcgcgctgctggtggccgccggatcggtgctcaattacttggtcagtgcgcgcaaataggggggtggctttgctcatggggcggtaataatcccatggggcggtaaaaccctcatggggcggtatcccaaaatggctttattctgccgtttcacaatttcttcaaaccgccccatgggccttttaccgccccatggataaattaccgcccgatgggcagcagcaacttactcgccgcggcgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggaccccgttgtctaaatgaaagtgcaacacccgttagattggaaattgcctagaaaacgttttctaggcaatttccaatctaacgggtgttgcactttcatttagacaacgggagttcgcgcccgttggccgagcagtagtagtatggtctgctgtatcaacaggaggagtgcgaccgatgcggctgatcgagacatggctggcggatccagaacgtgcatttgacttgttcgcgaaattcccggcggaagagacgggattcgagaacccggcggctggcatgaatcgtgaacggttcgccgcatatgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtatcgcccgcgaataccgcggccacggctacgcgaccgccgggctcaagctcacgctcgccaaggcccgcgagctcggcatcgaggaggcttacctgagtgtccacaaaaccaatccggcaagtcttgcggtgcagcagcattgcggcgcacgtatcgaccatgaagacaagacggaatactacacacgcatcgccacctgcatggagagcgatggcctctatgcgcgaggcgattgacggcgcctcttgcgtgtaaatggccgattatcaatcggttttaatcgatttcgcctcggtcgatagagtcgccgtcgaggaaccaataatcgtgcggatttccgcgtaacgccatgaacggcgtgagttccacgccctgtgtctcagctctgctcagcagataggcgcggataatccacggatactccagcacgcccgacttgagggtgatgatttgctccactctgctgccgctgacgccaaaatccttgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcctgcctcaaccaaagcacggccaacaccatgacgatggcaagattccagcacatatagcgaagccagttccgcagcctcggaccgtttgattggcgaacgcggcgtttgcagaagctcagcaaaaccaatcacgtggttgttctccaaagcgaccaatacgacctgattggggtctttggcgtggctgcgcgtcactttgagcgcgaattcgggagtgatcgcatccacgatttcctgcggaatatgcccctgattgagttcgcgccacgtgcacgactgaacttgggccttttcctcaaaccatggcggctcaatcgaaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaaactttccgttgaacgacaactcgctcatagtattcgagcatttcgaagtcgagcaacggttggagtcgaataacgcattaggttaggcgatagcaaaacttttcttcaggcaactctccgagctccgcaacatctgaaggagtgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccattttttcgcatgaaactgcgttgttcttgcttggagagggggcgagccccaccctgacaccgacgattaccttaccgcaatcatcaggtacggctcgtctcaagaatgaagacgtaacagtgagaaaggtggccgacaatcgctttacaattggcctggcgtcggctatcactatgttcgggcatacggttcgcgtttatgatttggaacgaaccatttgcgatttgttccgctcccgcagcacagtggatccgcaagatttgcaatccgccttccagaattacatgagatccgcgcacactgacttggtcaaactcatgaactacgctcgcgaatttcggctcgtgaacgtgatgcgcccttacctcgaagcggtgatgccggcatggttcaccggcgaattcatcttgtaggcagattcagcatcttgtaggtagctggccttggcgagaggtcattgcaatggcggtattccgatcatcgccattggaatcatctgcctacaagagcacgaaacaccctacaagatgagacgggccagttgggtcagtcccattcatcctgccggttcgcaggccgcaattgtcagtcacaactggtgcatcttcctcatccatgcgaatgatacgaatcgcctttcatcccaatgatttcgctctcatggccgatacccgcatgccgtcatgttccgtaccttggaatcagaagtcgagagtcatggtccgaaaccgaacggagcgggccgaagcagggagcattgaagatgggatttcttaagaacttttccgaaccgtttgcgttcgcgctggcattgtggccgtttgtgtccatgctgctgacggtgccggtgctggcgctgctgtatcaccgcgacaatcgcatccgactgtcgtcggccatagtggcgtatggcacggtgctgtatctgctcggcctgctgtgcttcacactgtatccgatgccggccgatgcggcggcctattgcgccgcgcaccatctgacaccgcagatcaacccactgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcgttcgccacgtcgctgtttctggagacgatgcagctgaccggcctcatgggcgtgttcccgtgcgcctaccgtctgttcgacgtggacgatctcctgtggaacacgaccggcgcgctgatcgggttcgcgctggccatgttctcgctgcgcctgattccggcgcgggtcgccgatacgacgccgaccaccacacccggcttcatgaggcggctgatcacgttcatcatcgacatgacgctgatcgggttcgccgtgatgccgacgcatctgttcgtcatgatcgtccaatcgaacctgccctcgggctccaacggctcatggcagtcgatggaaccgttcgactggaccggctcgatcctcttcctggcggcgctcatcctcttcgagggcgtggtgccatggttgcgcggcggctgtacgctcggcggcagcttcacgcatatgacagtggaaacccggccgcgagaaggctggcggcgtgcggcgttctatgtggcgcgcatggcgacgctgatcgccgtggtgtggtggcatagcggcggattcaatctgctggtgttcatcggcctcggcatcttctggctggtcaagcgtcagatgccgtacgacctgatataaaccggcgctccgctgcttggcgttacaggaaaacctccgaccactggtcgggattcggaatgctgcgcagcgggccggccaacgatacggccaatcccgctacggaacagaccacggctacggccatcaccgccgtgaaaccgagatctggctgttgcaacagccagccgaccatcgccgggcatgctgcgcccagtatgccgaccgtggtttcaaatacggcagaagcccgcccctgcatgttgtcgggtgtcttgccgtagagaaagcccagcaggccagcgttcaacgcggggaacggcaggccggccagaatctggcagatcagaatggccgcgtagctgtgcaggaatagcagtggcatctggctgaccacgaacaacgccagcgcgcccgcaatcagtttccctgtgggaaccatatcgactagcttgttggccaacagcgagccgaccaaagtactcacgcccattgccgtgccgagcagtccgatcatgaccgcgttggcgccacgggtggccaacatgatctgcgcgccggtgatactggccacgcaggcgatgttcacaattgcaccgagtatgatcgcggataggaaattccttttggtcagggcccatcgccagccttcgaccaagtgcgtgggaaatggcacaacagaagtgccgtgggcccaaacggcgaccacggcttagcgcgacgagtcaacgcgcattagctgtctgcgaacgacaccaacaccttgtgcataacaatgcccctttgcaaaaaacaaactccaattattgtaccagttcgagcatagaaccaggcgcgtcactgggcacaacataatcggccatcaatggtttctcggcttcgaggggctgatttcgtccggtggggacatctacttggctttcgaggggctgctcaaacgccaaaccgcgagtataaacggctttgcggcaacgccattacgccattgtggagccttgtctactcgggcatcagccccttgaaacggagatagatctccggcaagtgccaaatcagcccctcgaaatcgagttaggcgttgttttcgcgtttgcgctgccgttcgagtgcgtaataagccgcgtagcagcaggcgacgaacgggatcatgcaatacagggtcgaacgctgcgtatcatcgagcaccacgagcaccagcgcgccgatgcacatcacgatggccagccacggcagcaccgggaaaccgggcgcacgatagccgagctcatcggcgctgtgcccatcccgcgcccattcgcgccggaaacggatatggcacacgcatacggagaaccacaccaccagcgtcgccaaacctgacacggcgaccaacaccagatacacggtcgaggcggcgatcacggaagacagcaacgccagcagtgagcccgccatgctgaacagcacggcccacaccggcacaccacggaaattcgtcctagcaaaacgttcgggaatcagccgctccttggccagcgaccacaccatgcgcgaacacacgtacaggccggagttcgcggcggaaagcacggccgtcaacaccacgaagttcatgatgtcgccggcgaacggcataccgattgactggaacaccagcacgaacgggctcgtatccacgccggcctgatgccaggggatcaaggccgccatcaccagaatcgagccgatgaagaaaatcgccaggcgcagcaccgtggtgtgcacggccttgggaatcgcacgcgagggatccttggtttcgccggccgccacgcccaccacttcggtgccggagaacgcgaacaccacggtcagcaaagtcgagaaaatcggcgcgatgccgctcgggaaccagccgccggccacgaagttgcccagcaacggcgcggaatcatgaccggcaatcggtatggcgccgaagatcgccagcaggccgatcacaatgaacgcgatgatggcgaacaccttgattgacgcgaaccagaattccgcctcgccgtacagccgcacggacatgatgttgagcgcgaacaccaccacaatgaacacggccgaccacacccaggacggcgaatgaggaaaccatcgctgcatcagcagcccggccgccgtgaactccgatgcgagcgccaccgcccagttcagccaatacaggatagcaatggtgaacgcggtgccggggccgatgaaccgcttcgcatacatgtggaagctgccggcatacggcatggccacggacagttcgcccagcgagaccatcacacagtagacgagcagggagccgaccgcgtaagcgaggatcgcgcccaacggccccgcctgatgaatcgtatagccggagctgacgaacaggccggtaccgattacgccgcccagggagatcatcgtcaggtggcgcgactccattttccgttcgaggccggtatcgtccttgggtgtgccggctgccgccatgctcgggtctcctttggtcgggtgaacagttgtgtctcgtgtcggttgtgcgggcggcgctcgatgctgcctaccatatgatagcggtaacacgaacagcgagtggaacacgaggagtttggaatgacggaactgtatatcggatcgcatctgtcgacggccggcggatggaatgcgctgctggaacgctcccatgaggagggcggcaccgcgttcgcgttcttcccgcgttccccgtacggcaagcgttcgaaggcactcgacccggccgacgcggcggcgttcggtgcgcgtctgaaggctgagggctatgggccgttggtcgtccacgcgccgtacgtctacaatctggccggcaaggatgaggccaagcgcgcattcgcgatcgaggcgttggccgaggacatcgagctgctgaccgccatccgcgcggccggccaggaggtatatatcaacattcatcccggcgcgcatgtgggccaaggcgccgagaccggctgccggctgattagcgaggggctgaatcaggtgttcgagcgtgcggatggcgtcatggtgcttctggagaccatggccggcaaaggcacggaatgtggccgcaatttcgatgagctcgccacgatcatggatggcgtggagaataaggcgaacgtcggcgtcacgttcgacacctgccatgtgttggatgctggctacgatttggtgcacgactacgacggtgtgatgcgccagttggatgaggtgatcggcttggccagggtcaaggcgattcatgtgaacgattcgcagttcggcctcggctcgcataaggaccgtcacgccaacatcggcgaagggcagctcggcatcccgttcttcacgcgactggtcaacgacccgatcatggccaagctcccgatgatcctcgaaaccaaggagcagacgcccgccacgcatcgcgacgagatcgagttgttgcgcggattggtgcaaaagtagtcgtagtcgaccaatgtcgagcagaagagacctgtttttggctgagggccatacgaggttagctatcagcggggcgttgattgatccgtcttcatatacagctgcatagccggttccagctgcaagagctcaaaacagacgcatgggttcggtggaatccaatggctgaataagacgtttgccgtcgctgttcagtggcgcgacttcgtgaaattgcagacgccgggaaagcatggtacccgcttcccgcatggaatctaacagtgcggctccgtcaacggagcggtccagccatgaggcaaccatgttccgaggagccagcaggggcatgcgatcatgcaccttgacgaactcgtccgcggcagggcaggtgatgatggttgcggtcagctgccatggcgatgcgggagacggcctccaccatgagtacaggccggccaaagacaatagttcatcatgtggcgcgtgaaaatagaacggcctgcgacctttccattcgtagtagccggaagcggggatgatggctcgcatggattttgtggattcggtgaacgccggcttgacatgcgcagactccacacgcgcattatatgtggggtagctcagcactttgctggcgctccatcgcggcaccagcgaccaataggcaccggtcagatgacggcggccatccttgccctgtgccaccacgccaatgttctgcgtgggtgcgatgttgcaggaaggctgtggcagagtgtcaacgcgcacgtcatcctcgtctaccgcgaactgtgaggccacggcatcccaatccaagtcgagcgcgaatctcctgcacatgcgctcagtttatgccatcaatggaatcaatcccaggccgtatgaccgatattcatggcgattttcctttttgttggccgctctggttccgtagcgatacgaaccaacgaggaatagcccagaatgtaggacgggttcggcaatcgggacaggacgtgacctagagtggcgcatgaccgaacaccaacaaagggaggaccatgtcggttttggacgaactggtggcgggagcgctggaggatcagcgcgcccgtgagctcaccgtatcgcttgaggacgtgaagaaggccgcgctggcggccccggctccgattgacgcgacacgatggcttaagcgcgccgacggcatccccgtgatcgccgagatcaagcgcgcgtctccgtccaagggccacctgtccgacatcccggacccggccgcgctggcccgcgagtacgagaagggcggcgcaagcgccatctccgtgctcaccgaaggccgcaaattcctcggcagccttgacgatttcgacaaggtccgcgccgccgtgcacattccagtgctgcgcaaggacttcatcgtcaccgactaccagatcttcgaggcccgcgcccacggcgccgacctagtgctgctcatcgtcgccgcattggacgacgcccagctcaagcacctgctcgatctggcgcacgagctcggcatgactgtgctggtggagacgcacacccgcgaagagatcgaacgcgcccgcaaggccggtgccaaggtgatcggcatcaacgcgcgcaacctgaagaacctcaaggtggacgtgaacaaatacaacgaactcgcggccgatctgcccgatgacgtcatcaaggtagcggaatccggcgtattcggcgcggtcgaggtcgaagactacgcccgcgcgggagcggacgcggtactggtcggcgagggcgtggccaccgccgacaatcatgaacttgcagtggaacgactagtaaaggcaggagcacaagtgaaagcatccgaaacgaccccgctcagcgaacatcagggaccgtattggggccagttcggtggccgctatgtgcccgaggccctcatcaccgccctcgacgagcttgagcgcgtgtacacgcaagccaaggccgaccccaaattccacaaggaattcatgacgctccagcagcgttacgtgggccgcccgagcccgctgaccgaagccccgcgcttctccgcacttgtcaaagagaagaccggtctcgacgcccgtatcttcctcaagcgtgaggacttgaaccacaccggcgcgcacaagatcaacaacgcgctcggccaggccctgctcgtcaagcgcatgggcaagacccgcgtgatcgccgagaccggcgccggccagcacggcgtggccaccgccaccgtgtgcgccatgctcggcctcaagtgccgcatctacatgggccagatcgacgcccgccgtcaggccctcaacgtggcccgcatgcgtatgctcggcgccgaagtggtcgaggtgaccctcggcgacaagatcctgaaggacgccatcaacgaagccctgcgcgactgggtcaccaacgtcaaggacacgcactacctgctcggcaccgtcgcgggcccgcacccgttcccggccatggtgcgcgacttccagaagatcatcggcgaggaagccaagcagcagctccaggactggtacggcatcgaccatccggacgcgatctgcgcctgcgtgggcggcggctccaacgccatcggcgtgatgaacgccttcctggacgacgagcgcgtgaacctctacggctacgaagccggcggcaacggccccgaatccggcaagcacgccatccgcttcgcccccggcaccggccagctcggcatgttccagggtgccaagagctacctgctggaaaccgacgaaggccagacgctcgacacctactcgatctccgcaggcctcgactacgcttccgtgggccccgagcacgcatggctcaaggacatcggccgcgtgaactacagctgggccaccgacgaggaggccatgaacgccttccgcgacctgagccagaccgagggcatcatccccgccatcgaaagctcgcacgccgtggccggcgcgtacaaagccgccgccgatctgaaagccaagggctatgacaaggccgtgatgatcgtgaacatctccggccgaggcgacaaggacatggccaccgccggcaagtggttcggctacctgaccgacgaccaggccgccgcgctcgatgtgaccggcgcccacggcaatactgtcgcctgaaccagaagaggagatttttgattatgaccaacgaagcaaccacgccgtccggccagccgctgggcatcagccacaagcccagcaattcgggtgctatgttcaccaagttcaaggccgagaacaagcccgccttcatcggctacctgccctacggcttccccaacccggacgtctcgcttgacgccttcaagacgatggtcgagcacggcgtcgacgccgtggaaatcggcctgccgtactccgacccggtcatggacggcccggtcatccaggctgccgcctccatcgccctgaacaacggcgagaccatcaagcgcgtgttcgaggccgtcgaaaccgtggccaacgccggcggcgtgccgctcatcatgagctactggaacctcgtgtaccactacggcgtcgagcgcttcgcccgcgacttcgagaacgccggcggcgccggcctcatcaccccggaccttatcccggacgaggcgggggagtggatcgaagcctccgaccgtcacggactcgaccgcatcttcctggtctccccggactcgtccaccgagcgcctcgaaaccgtggcccgcaacgcgcgcggcttcgtgtatgcggccgcccgcatgggcgtcaccggcgaacgcgccaccatcgacgcctcgcccgaactcctcgtggaacgtacccgtcaggccggtgccgagaacgtgtgcgtgggcatcggcgtgtccaccgccgaacagggcgccaaggtcggctcctacgcggacggcgtcatcgtcggctccgcgctcgtgcacaccctgctcgcggacgacaacaagaccgcacgcgacccgaaggaaggcttgaagctgctcgccgccaagagcgaggaactggccgaaggcatccacaacgcccggtaaacacccggtgcgcctcacgcgggttgtgccgtgacacggtagggtagtcacagagcatcaagcacaacccgcgcgtggacacaccatgagcaccagcaagtagaggcacgatgaatctggcttatattccctcgccgaccttctccaagttcgagatcggcccgttcactatccacatgtacgcgatctgcatcctgatcggcatctgcgtggccgtatggatcctcaccacacgttggaagcggtacggcggcaccttcgaccagattctcgacaccacgctcgtcaccgtgccctgcgcgctggtgggcgcgcgcctctaccactgcatcaccacgccggccgactacttcccgcccaccggcaacttggtcaacatcctcaaggtgtgggaaggcggcatggccatcttcggcggcatctccgtcggcaccttggtggcgttcctgtggtgccgccacaagcactatccgttcgcgatcttcgccgatgccatcgcccccgcgctgcccgtggcccaggccatcggccgactcggcaactggttcaaccaggaactctacggctggcccaccacgttgccgtggggcctgaagctcaacgacgcggacgccatcggcaaatccgaaatctgctattccggcgcgcaatgcccggactacagaaccacgctgttccacccgacgttcctctacgagatgatctggaacctcatcggcgccgcgctcatcatctacctcggccacaagctcgccgaccggctcaaggccggccagcagttcgccatgtacctgatgtggtacggcctgggccgcacctggatcgagaacgtgcgcatcaactactccacggtgatcctgggcctgaggaccaacgtgtggaccgcgatcatcgtcttcgtgctcggctgcatcctgttcgtcgtgctctaccagtacggtccggaccccaaggcgcaggcgcgcgggcttgcggcggtcaccgccgacgagctcgaacgccagagcatcgaagaggaacagcttcgccagaagaagcaggccaagcgcactaagtgacaccacaataaacagcgccgaaacagcgcgaaacacgggaccccaagtcccattgcacagataaggtaggaaaccatgagcaatatcgcaatcgcacccagcatcctgtccgctgacttctgcaacctcgaacgtgatctcaaggccatcgccaacgccgacttggtccacgtcgatgtcatggatcatcatttcgtgccgaacctgaccctgggcgagccgatcgtcggccgcatctgtcaggtcaccgatctgccggtcgacgtgcacctcatgatcgaggacccggaccgttgggctcccgaatacgccaagctcggcgccgcctccatctccttccacatgggtgccacccacgcccccgtgcgtctggcccgacagctgcgcgagatgggctgcaaggcctgcttcgccgtgcgtccggccgaaccggtcgagccgatcttcgatatcctcgacgagttcgacatggtcctcatcatgaccgttgagcccggcttcggcggccagaagttcctcgacaaccagatggccaaggtccgccgcctgcgcgatgagatcacccgccgtggcttgaagacccgcatccaggtcgatggcggcgtgagccccaagaccgcgcacatcgtggccgaagccggcgccgacgtgctcgttgccggttccgccgtgtacggcgccgagaatcccgcccaagccatcgacgacatccgcaccaaggccgaggccgcgttcaaggcctgagctccaagcctgaaccgcaatccacctttcatccataaccgcaagaaaagaatctgaatcacatgaagacgtttgaatccctgttcgccgaactgtccgaaaaggcccagacccgccccgaaggctccctgaccgtcgacgagctcgacaagggcacccacttcatcggcaagaagatcatcgaagaggccggcgagacctggatggccgccgaatacgagggtgcggaccgcaccgccgaggagatgagccagctgctctaccacgtccaggtcatgatgatcaagcacggcctgacgctcgaagacgtctacaagcacctgtgagaggaacgcaaatgctgagaatcgcagtgcccaacaagggcatgctatccgaacccgcgtggaacatgctggccgaggccggctaccgtctgcgcaccaaccctcgccagctggtcgtgcaagatcccgacaatggcatcgagttgttctacctgcgtccgctcgatatcgccgtatacgtgggccgcggcgccatcgacgtcggcatcaccggccaggatctgctcaagaactccggtaccgccgcgctcgagcacatgccgctcggctttggtgcctcgaccttccgtttcgccgcaccgaacgaatccccgatcaccaccctggaggatgttcagggcaagcgcgtggccaccacattcgataagctcgtacacgactatctggtcgagcacggcatccaggccgagaccatccatctggacggtgcggtcgaatcctccgtgcagctgggcgtggccgatctcatcgccgacgtggtctccaccggtaccaccctgcgcaacgccggcctgcgcgtgtttgccgaaccgctcatgcactccgaagcttgcctgattcgttcgccgcgtctgaacgagcaggacccacgtctggccgtgctgacccgccgtctgcaaggcgtgctcactgcacatcagtatgtgctcatggactatgacattccgatcagcaaggtcgccgccgccgtggccgtgacccctggctttgaaagcccgacgatctccccgctgcacgacaaacagtggaacgccgtgcgagtcatggttcccaaggccaaggtcaaccagctgatggatgatttgtacgaagtcggcgcacgcggcatcatcgttaccgctctgcaagcctcccgcatgtagagtgttagtcgatatgaccaaccagaaagtcaacgccagatacagtccggaagcacgtgacatctatttcactgtgcccaatttgatcagcgcgctgcgaatcatctcgattcctttcatcagcgtgctgatctccaagcacgagatgattgcggcgctagccctgatcgccatttcctcggcttcggacggacttgacggcatcatcgcgcgcagattcaaccaagtgagcaagatcggtcagattcttgatccgatcgccgaccgactgctcattttctgctcgattctggctctcagcgtcgccggcatcatcccatggtggatgctgattatcgtgggactgagggatctgtggatggcgattcaggtgctatggcttgcccagtacggttatggtccgctgcccgtgcatttcgtgggcaaggccggtaccgcgctgctgatgatttccatcgtcggtctgattttcgccgatttgggcaccagtacgtttttccacttgctctacatcgccgcgctggccgccggcatctggggcatcgccatgtattggctcgccggatatatctataccaagcagggcgtcggattgctacgcaaggaactgggggagaagtatggcgcttgaggccacggccccggtctcattccccgtacccaaggagaatgagccggtacgacgccgcgccgtgttctcccactcagtccgaggcgcggaatcacatcatgcgctttccccggatgacgccgccgccatccgcaccagacgtcgccgtaaaaccaacgacgattcgcttcagctcatcgatgatcttgtcaatcgtccgatggatccgatgttctccgactcacgactggtccatgagcatcgttcgaccttctccatctggtttaatcgcatcgtcgtattcatcatctgcgtcggcgttggctttgcctgcagcctattcgtgcaacagttgcaatccgatccgcgtaagcaggtacggcagactttggccacgcaattggagaatcgcaactcgcaaatagacgaactcaccacggacgtcaataatttgcgctcccaagttgacgaacagtccaagaaaatatccggcagcgtgaaaagcgatacgcttatccaagacgaaatggtcaatggtgccacggtggtcgaaggcgaaggaatcaccatgacgctggccgatccaatcgcggcaagccagtcggatcaatcctcctcgacgagagtcggcacctccacgaacatccgagtcatcaccgatctggatctgcagcaactggtctccctgatgttccaaaacggagccgaagccattgccatcaacggtaataggctcggcgcgcaaacctcgatacgcaaggccggcgggcatattctcatcggcatgaccgcgatacaaagcccctataccattgaagccataggcgataagagcgccttggccgaagcgatggggaagaagaaacttgcaagtctttacgattccttcaaggaagccggtatctacccgcaggtgagcaaatccaattcgattacacttgaggcagcagtcactggcgaagtgaagtacgcggaaaggaatgaataatggcagccgttctgggactaatcatcggcgtcgtcatcggcgtgttcgtcaagccggacattccgatcatcgtgcagccttatctgccgattatggtggtcgctgctcttgacgccctgctgggtgccgcgcgagcctatttcgagcgcagcttctccgaccgcgtgtttgtgatctccttcctcgccaacgtggtgacggcaacactgctcgtgttcctcggcaaccagctcggcgtcggttcgcagctgcagacagccgtcatcgtcgtactcggcatccgcatcttctccaacgtgtccgcgatcagacgcttcatcttccgaggctgacaagggtactgacgtatggcacgtaaagcacaatcagacaacatgctggagaaaatgcgcgaccagcatgcacaagacaaggtcaacgaccggatggaaaccgggtcgtttcccacggtgcgtaagaagccccggaaggatctcaaccgtgccagcaacaaatcacggttactatcctcgattctcatcgctctgatgtgcgcgttgttgggtttcgcctacatgagccagatcaataacactaaatccacgtacgaaacgatggacgagagtgaactggtaaggctgctgaacgagtcgaatacgcaaatctccaatctcgagcagcgtaaaacccagttgaacagccagctcaactcgctgaaatcggcggctaacgagcaggagcaggcgcgtaagatcgccaagcaaaacgaggagaccagcggcttgatctccggcagactcccggcaaagggtcaaggcgtgaccatccgaatcggacgaggcttgacgactaaagtggacgcctcaatcatgttcaaccttatcgaggaacttcgcaatgccggtgccgaggtaatcgccatcaataacgtgcgcgtcatcacctccacctacattcaggacgccgaggaaggtttgatcgtggatggcaccaccatcaagcccacatacacggtgaaggccattggcaatccgcaggaactgtccaacgcagtcgatatcgccggcggtgtgggcgctcagctccaggtgaaatacgggtccaacgtcaatgtacagccttctgacagcatcattatcgacgaagtacgcgaagctacgcaaaaccagtatgcaaagacggtagaataggggattatgaccaacccgattcctagcgcaggcgaaaccaccattatcggcctgcccgcgattaatgtactgcccattaccaccaccggcgatcgaccgctgactcaagaggatctggacaccatcaccagattgtccgagggaacggcattgctgatttccgccaggggagcggtctcaggttctcgttacttgcttgacgaggatgaaatcaccgtcggccgtgatccgcgagctgatattctgctcgacgactccaccgtatcccgtcagcatgccgtgttccgcagggtcaacggtcagttctttgtggttgacgcaggaagtctgaacggcacctacgtgaaccgtcagcgtgttgatcaggcgacgctgaagaacggcgacgaaatcatgatcggtaaattccgcctcgtgttcttcacgaaatctgccattatttcccaatagtccacacccagcacggggttagactgattgcagaaattgcaatcatgtgattacaccagtgtgagtcatatgcgagacacgcatgagttaggggagtgccatgggacagaccgggctgcatcttcatgtttcgcttgaggaccgtcagaatctgaacgctgacgcgattcagggggagttgttctccaacgtcgatactgaggagatcaagcgcggctaccgtggcactgtggcctccaaggtggccggcatcacgtaccgacagctcgattattgggcacgcaagcagattgttgagccgtccatcacgccgtctcatggctccggttcacgacgactatactcgtttaaggatgtggtgattctcgctgtatccaagaagttgcttgatgccggtgtgaatctgcagaacgtaacggcggccatcggattcttgactcaacgcagcaccgatcagctggccaatgtgaccatcatgtgcgatggtcaaaacgtacatgaatgcacaaccagcgaacagatgctcgaactgttgcaaagcggtaaggcagtgttcgccgtgtcggtgggttcgttgtggcaccagattgagacggccttggaacaggaagaatatgttgatcttgaggccaagccgctgacgattgccacgggccgtccgattgatgaactgactgccatgaggatgcgcaagaagctcgaggcacagcgcttgcaacgcgcaaccgcctgatacatgtatggttgttggcgacttgccggctttggtcggcaggtcgctttgttgtatgtgttgcttttgttgcctgccatcttatgtttttatatgttgcggtgattattatgactgattggaggaccgggtgaacgggattgttgtcggattgttgccgggcgttctgtggatggtcgccgtcatctttgctgtgtccatcatcactataacggtcagccgaggtcatctgttcacgccgaaacgccggcgaccgccggtcgatccggtcgactggtcgatggtgaaaacgcatttcatgtcgtttgcggcggcgctgatcccgtttcccgtgttgacgtttacagcggatctgatgaatgctcgcatgctcgcgttctacgaccacgcgcaattgcccggagcaatcatcatattcgcgctggtgctgctggaactcatcgccatgtatctgcaggcacgcaacgcttcggaaaccgaaatggacaagcgtttgggcgttgcttctcaccggaataaggatgatgttgcgaagtagccgattctctgcggcgaggctaatccgcaactagatactactggttcggctaaaatcaccacgtactattagccgataatgtacgttatgtcagattagttatccttgacaaggattcggtcgcctgtatcaactagtccacgcataccaaggccgacagccaaaggagcaccggagcgaccaccgcaattgcaagaatcgccgtgcctttcagccaatccttgtcatctcgtttccagtggaatgctcgccaaatgaaccatatcagcatgggaatctcatacagcgacagcaatggcaaaccgatgaaaaccaggtcgaagcccgcggcgcaggctccatcgcatcccatcatgaagaagtccccgccgttgtgtttcagtgtgtttggaaataacggtttacggcttcttcgatctgctcgggcttctcgatgatttcgtaggcaccgtgttcttccatctcaccggccggagcgtagccccagcggcagccaatggcgtccagattgcaggcgtgggcgccgtcgatgtcggtgtagcggtcgccgatcatcacggccttgtcccccgctgcagcatcaaaaccgattttgtcgaagcagtaccgaatcacctgatccttgtccaaacgagagttatccctggatgcgccatagatgccgtccaacagctcggtcagatggaaatgctcacagatcggaacgcattggtactcgggcttgcagctggccaacgccagataatagccgtcggcacgcagcttgagcagctgttcgcggataccgggaaacacgacgttcaccaagcggccgggaactttgttgccgggctcgttcggatcatcgaacacggcgcgatccgcatagtagctgcggtagatggtgaccgcccggtcaagctcatcctccggcacatggttgcgtcgcagcgattcgatgatggccggaccaatgaaacgatgcagctcggcatcgtcgggaaccgggcgacccaattcctcgaacgtcttgacgacggaggcgatgatgccgccgtcggacttggtaagcgtgccgtcgaggtccaacaggaccactttcatcggatgctgtgccattgagattccactcccctttgttcatgtcgactgctttgaatggtcgtcaaacaatgcgacttgttccaacaatgattatgcccagtcgggatgactgggcatcaagttcacgtgttgttcagtaggagatcactcgtagtcgggaatccaaccgtcacggtgcatttgcaggcgcttttcgagtagggtggccagttcctcttcgctacggcgttccagcagcatgtcccagtgggtgcgggtgggtttgctgatttcgtcgccctcacggtcggcgtcgccctcacggtgggccacggaaccacaacggcactcccactcgtccgggatttcggcaccctcggcaaacggcaggatggtgcggtggcccttcgggcatacatacgccacatcgtttcgtgcggcgaaatcgacgttgtcgtcggactccagcgatttcgctccgatgctcatgcccctgaggctacgttctgccatatcggcatcctccttgaaagatctttaaccctactaatttacgcaacagttcggacttggccgctattccaagcttccgacgtcggctgacaaactcccgtcaaacagccccgtcagtccacgccggagtaggccaccacgccacgattgacccggtcggccgcttcgtgggcgaggcctgccagccgctctcccccgtcgaacggcagcggctgggcgacagcaatctgctgcagcacgtcagccagtcgtttggcagtgcgcacgaagtcgccgccggtcatgtcggtgccgtacaggcacgatcccagcgaaccgccatccgcccattcatacatgatgtcgagaatgccgaaatccggccgctgcatctcgtccagaccgtgatcctcgcacaggatatcgatgtcttcacaaatgcccttgagcttggacgaagcgatggcgatgggcccggagatgccgcccgggtagtgcctcggttcgccgtctcccccgcgtctggcctcgtataccagtgaagagagcacagcggccagtccgttggcgtcgagcttgtcgaacgtgccggcgagcagcgcctcgcacagttccaggtcatgttcactgtagatgcggcgcagcagcagacctttttcagtcaacgtcatgtcaatgtggccggccgcattgacatgacgttcgaggtaaccaagcccggtgagaatatcgcagatgcaatcgaactggcgtgccacggacccggtgcgggagtcgtagcgatcggtgacgcgctgcagttctcgagtctcgcgggcccagcggtggccccatttgaggtgttgctggaggtccgggcagttgcggcatggatgctcgtgttccgccttgcgcaaatcgcgaatgcgctggtcaaggttctggaaggcgcgtgaacgctcctgatcggtcaggaacacttcgtgcttcagtttgcggcggccttccttttcgatgtcgctcagctccatacgcagggtcatgaactgtttgaagtcgccgtgttcgcatgcgaacgcctgttcgtatccggccagcgcgttcttcagtgtgttaatctgcgattccagctgccaggccgattcgttggcctcccactgggcaaacgactggtccagggtgacgcgcgcggtctcgtagtcgctggagttgagcaggttcacggccatgttgaacgtgggtcggaagctcgagtgcagcgggtagacacgcttggatgacagcgaggcggctgtggcgggcacaaaaccgtgatggtcgaccacgatggcgtggccgatggtgtcgatgccgcgccgaccggcacgaccggtgagctgcgtgaattcgccgggcgtcaggcccacatgaccggtaccgtcgaacttttcgagtttctctaccaccacgcagcgggccggcatattgatgcccaatgccagtgtttccgtggcgaacaccattttgaccagaccttcttcgaacaatcgttcgactatctggcggaacagggcaatcatgccggcatgatgcgaagcgaagccttcttccaatgcaaagcggaacttggagaactgcagggctttcaggtcttcctgagtgagttgcccctccaccatctcatccacgatgcggcgaatcttggtcacttcctcatcggtggtgagctccagtccagcgttgatacactgttccacggcctggtcacagccgttgcgcgagaagatgaagtagatgccgggcaacattcccaggaagttaagctcgtccaccacggcccagcggcgcggggtgtggcgttccgctttcggggcatggcccttggcgcctttgccgccgcggcctctgccgaagcccttgcgcttatcggggcgttcctcgccgcgccggcgtgcggccttgcggtccaactggtcgagccggttgatgagttcggcgttgagtttggtggtctgctcgccgttgccgtcgcggcgatagaggtccagcacctcgggctcggtgtgttcgtccgcctgcacgatgacgtgctgttccaaaggcacggggcggtgttcgctgatcaccagtttggtgtcgcctcgcaccgaggcaatccagttggagaaatcctccacgttggacacggtggcggacaggccgacgatcttgaccgtcttgggcaggtggatgatgacttcctcccacacgggcccgcggaatcggtcggccagatagtgcacttcgtcgagaatcacgtagcgtagtgcgttcagcgtggtggaacgctcgtagagcatgttgcgcagcacttcggtggtcatgaccacgatgtccgcctcggagttgatcgaggtgtcgccggtgagcaggcctaccttgtccgggccgtacacgtcgaccagatcatggtatttctgattgctcagcgccttgatcggtgtggtgtagaaggctttgacgttgcgttcctgggcgaggtaaatggcaaaatccgccactacggttttgccggcaccggttggggccgcgaccagtacgttgctgccggcttcgagcgcgtcattggcttcggtctggaagtcgtccagttcgaagggcagggattcggcgaatcgcgctgctgcggacgcccgatggcgttggattttctggaatgatgcgtaccgctgcgaagggctcagcgtctgggaatcggcattgcccttatggtgttggtgacgtgccattgctgctttccgttagttgttgaatcgcttccagcgggcccatgcctgggtgtggcgctcgcgcttggcggccttgctgcgaatcacgtccgcatgggcctcggcataacgattctgtgccacgctgagcggctgagtgaacagaggcggctcgctggtgtcggcagaagtgccgggctcccccatcgcggccacacgttcaccgagttggccgccgatgtcggacatgtctttcagggcacggagcccatgaagggctgcatagatgagtccggcaacaatcatggccagcatgaacagggccagaatcagccatatccaccaaggcatgaaaggctccttacttgttctcgctgacgctcagttcgcgttcggcgcgtgccacgatcatggtgcgcaacgtttccggggcgaccgccgtgatatgacgcgcgtgtgcgatgcagaaggccacgaaccaagaatcggaggaaacggtcagatgcaccttttcaccggcaccgcattgttcgacggtagcgcccggcaatgtcttgatgaatgccagatcgcgctgatcggtgatgaacaccgcgtcggtaccgttgtcgaaactccacttgcgcagttcgctcaccggcatgttcgggatgttgatctgcttggtgggcttgaccagttccgccttttcgatacgggccaagcgcagcacctgccagatgcgcggcttgccgttcgccttgtcgatggtcttgtctttggagacgtaggccttcttgtccttgggggcggcggaaccgacatccgtgtagacggcggcataatacacgccttcgtcgatgaaaatcttggcgggggccaccagcttgcgacgggtactaccggtaccgtcggagtactccatgtccaacagcgaatcggtgttgatcgcgcgcttgacgatggagaagcttcggggctccagctcatagccggtcaggctcagccacggggtctggcccgggctgacatggcggcgcaaacgctcatacagggattcggcctgcccacgctgcttgtccggcagtaacggcgaatgcgccaagtagctgaccgaggcggtgagcatgctgaggtattgcggcgaaatgccggcaagacgttcaaggcccaacgagttggtggcggaaacaataccctcggcatccagcagcggccagtcgatatcgaagaactggctgccagccatctcaccatcgtcggaaacggtggtcagggtgttgatgtccttatgaatgatgttgacgaatttcttgagctcgtcgtcgttctttggtttgccgataaagcgctcggccagctcgctcatcgagaattcctcacccaggtgagcggagaggaacagcatcagacgcaggcgacgatccacctcgctgcccgtttggaaagcggatccgttcttcttgttctgggccttgatcgactcgggatcacccggctcacgaacatcgcgactaatcgacggggaaaccaccgaggcgcttacagggctggcggattcgtcggccaaagtgaatcggctggcggcgtgcaggcggcgatgataggcgtccacagcctcctgcgggctgacaatcgtggcacccggatgctccagcacaaacatggccaaatcgtcggaatcggtgtaggccacgttcaggtgttcgccgtccacatcaacggtggcggcaaagcgacgcgaatcgataaccttgaccagcgagtccggaatgggctgcgtgcccaagccaggcgcaatcgaatccaaaccgagaccgggaataggggtctgcggcacacgcggcgtggtgcgcgacgcatgttgggcgagctgggactgatccggctcggaggaaatcgacatcgaacgagccagatagttggcggcggcaagcaccggcatatcttccggctcgaacatcagacggatgcgcggttcgtcgcccaactgcagacggtaggacgcgaagtcctggccttccgacttggacgaatactcaggctgccgtgattcgatggcgatgcccatagcggcgagcttggcgcgatcacgctggaactgcttggcgaacgcggccttggcggcctgatctgccagctctccatacgagtcggcgtaagccttgacgcgctgcgcaatttggcgggatgtgagccattgcgggaacgcggatgacaacacagccagtacgtccagctcgtgcttgccccatttgtcggaaaaacgccgacgtccgcttgtgccctctgccattagtcctcacgtatagttactgtttcgttataagtgcgtatgagtttccccacactcactctatcttagaggctttttccgcacttgagcgccatttcacaaaaataatatcttttttatcgttcgaccgtgttgtaaatcacacccaatcgtccggttcgatgccttgcgggccaacgtattcgccgttcggaacatagcttggttcgcccttatcttccagtttggcgtcggcgaacatcatgacgtcacgtccgaatgtccagtcgccctgaatggaaaccgagttggctgcggccaaagatggcacggcgtaggggaaccgttcgtcgaaatcgtggatgttcttgtagtatcgcggatcaagttcgacgttcgggaagatgtaattgccgtcttccatctcatacgtgtccgtcaggtggaagcgatcggaacgcataatgaacaaatcattggtggttttcaccggaaggaagcgcatacgatccacttggacgcagatagaaccgttgaacagaccgattgcggcgcccatggcggtttccagctgaatcacctgttcggaatccgggtccgtgggattcacggtctttttgttacgaatcaccggcaacggcaacacaccatcgcattcggcgagcttgtctttcaaagcgtcgatgcgaacccagattgagttggtgttgaagtaaggatgcttggtgatgtcttgggccgcttccttatcgtccggatggacctggctcatttcacgcagtattaggcgaccagtggccttgtctcgtacaatatggccgcccttgcgatcggccttggtgcggatggccacttcagccataaacggggcacctgtgttttcgaagtgctgggccaacgtacgcgaggggcgcgcaccgagattgtcggaattggagatgaacagatacttgaagccgcgctcctccaatacgtcaagcagaccagactcccagatggtggagaacaggtcgccgtggccgggcgggcaccattccagctccgggttcgcagggtagctcacaggttcgccggtggcggccacgagcttgggttcctgatgctggatgatttccatcggcacgtcatgctggctgaacttgcgatgatgcttgagcaccttcatcgtgtccgccgaagtgtggaaggagttcatgaacgtcagcggcagttcgacgttcaggcgtgtgcgagcggtaagcacctgaccgatgatgatgtcgatgaagcgcatctgcttggccttgtgcctacgcaccggcaacagcgacttggccttgtctaatcccatggaggtgcccagaccgccattgagcttgaggaatgcggttttggcgaaggcgtccacggccttgtcgtggttgatggtctcatagacgtcgtggaagctgggcacgtggccaagcggctcgatgtcgtcctcgcgaatccagctggaggcttcttcatggcgccatacgtcatacaaatggtggaactggttgatggcggtttcgctcatgccatgctcgcgcatcttggcggccgaaagctcgaaagtctcatccacttcgggggtgtttacggtttcttcgggggtatccgaggtgacggcgtcggtgtcgccggcggcggcgatatccagttgggccttatcgtttatttctgtcaattcgggtccctttcgtcaaatcaataggaacaagtctagtccctgtttggggcaaacgcatacgacgggggtgcggaggcggtgaattgtcggtgataattcattacgaatggcttacaaaggtaagtccgtcgtcatgttgtctcatattgtctgaaaacggaaaaaccccggaagacaaccactcaaaagtggcagaattccggggctaatcggtcgggccggcgggatttgaacccgcgaccccttgacccccagtcaagtgcgctaccaaactgcgctacggcccgatggtgcaaaagcaccgagtagataatttaccagatatttgaaatctggcaaattacgcgcgtgtcacttccgcttcttcttctcgcggatgttcacggagatctgaatcggcgtgccttcgaagccgaattcctcgcgcagggaacgctcgatgtagcggcggtagccgtgctcgaggaagccggtggcgaagatcacgaaacgcggcgggcgcgtggatgcctgcgtggcgaagaggattcgcggctgcttgccaccacgcaacgggtgcgggtgggcggcctgaattttgccgaggaaggcgttgagcttgcctgtaggaatacgctgatcccaggattccaaggccttatccatggctcgcgtcagacggttggtgtgccagccggtcttggcggacagattcacacgctcggcccacatcacacggtcgaattcggtgttccacaggcgttcgagacgctgcttgtcgaactcgtccatcgcatcccacttattgaacacgagcacgatcgcacggcccgcatccacggctgtggacatgaccttcaaatcctgatcggataccggctgcgaagcatcaaacaggatcagcgccaattcacagcgctcgatggcggcctgcgtgcgcagagaggaataatattccgcgcctgtgagcttgtgctggcgtcgcttgatgccggccgtgtcgatgaacagccagtcctcgccatcgatgttgacgatttcgtcgacggggtcgcgcgtagtgccggccaaatcgttgaccacggcacgttcttcgcgcgccagctgattgagcagagacgacttgcccacgttcgggcggcccaccagagccacgcggcgcaggccggaaggcgtgaggtagccggaagtcttctcggcctgcttgagcttgtcgagcgcgacgtccagcaggtcgcccactcccctgccgtgcatggcggaaatcgagtatggttcgccgaggccgagcttccagaattcggcggcaaggtattcgctggcctggtcgtcgatcttgttgacggccagcacgaccggcttgccggcggcacgcagcatcttgacgatgcgctcatcggtggtggtcatgcccacttgaccatcgacaacgaataccacagcatcggccaaggtcacggcaacctgtgcctgtgaggcgatggcggattcaatgccttccacgtcggcttcccagccgcccgtgtccaccagcttaaagtcggtgccggcccattccgcgtcatagctcacacggtctcgcgtaacgcccggcgtgtcttccacaacggcggcacggcggccgaggatacggttgaccagggatgatttgcccacgttcggacggcctacaacagccagcacacccaccggcttggggccggccttgcgcgcgccttccgtgaaaccgcggccggaaatcagatcctcatcgccttcgtccagctcatagccttcgagattggcggcatactgctcgtactcctggttctcgatggcgtcctcgaccagaccgatgagcagatcgagcgtgtgggcgaagtccaaatcggaattgtcgatggtagtaacgccatcggcggcggtcaggaagctggtgaccttggaatcggccttgtcgcgcgcagccacatcctcagcacccacgcccttgacggcttggccggtgcgacgggcctgacggacctcctcacgggcggtcagcagcacgcgcacctcggcgtccggggacaccacggtggtgatatcgcggccctcggccacgatgcccaaacccccggagaaggagtcggccgacgcttcgcgggcgatgtaggcgcgctgggcggcgatgagcacgttgcgcaccgggatgacgttcgacaccttggagacatggctggagacttcggaggaacgaatggcctcggaaatgtcctcgtcgtcggcgaatacgcgggggttgtccgggtccacggagatatcgaaatggtcgccggtgaagaactcgcccaccgcttcggtgatgacacgctcatccacggtttcggcgtccagatcgatgccctgcttcaggcaccaccaagcgcaggcacgatacatcgcgcccgtgtcaaggtaggcgtatccgaaatacttggccagcgccttggacgtggacgacttgcccacgccggcggggccgtcgatggcaacgcgaatcacagaccaacctccttggacagcgaacggacttccgtctgggacagcacgcggtaggaaccgggcttcaaatcaccgagcttgatcgggccgatctgggtgcgcaccaagcgcttgaccgggaagccgattgagccgaagatacgtcgcacgatgcggttcttgccggagtgcagcacgaccttgaccatcgtgtggtcacgcgaggagtcgatgatcgcgcagtggtcgagcttgatccagccgtcgtcgagctgcacgccggtggtcacgagtcgacggcacacggtgccggagatcttgccttccagcgtagcgacgtaggtcttctcgacctcgtacttggggtgcatgacgtgctgcgagagctcgccgtcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgtttagtgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagccaatcccaacctatatatcataccgcaacgtaggactgctgctagactggcaaccgtttgtgcgggttcgcccgtcttccgacagatgaaaaggaatgaacaatcatggaagaaaccaatcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctctgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacgacgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttgtgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttggccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacagccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtggcccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggagggaccgccgatgtcgatcttctcgatggtatcggcctcgttggcgccggagcgcacggtgtcggcgaacgggtacaggttgacgaccaccaggtcgaacggcttgatgccgaactcctcgagctgcttggcgtgctcggggttggtcatatcagccagaatgccggcgtgaatgtacgggtgcagcgtcttgacgcggccgtcgaggcattcggggaatccggtgacatcggacacctcggttaccttgacgcccagttcggcaagcttcttggcggtcgaaccagtggaaacaacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgaggtcgtggcggtggtgcgggaatccttgattctctcaaccaaccagactatcggaaaaacgagcgctatgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtattccgtacattcaacggtctgcaggcgaatccttgcggtaggaatacagccagcaggcccacgagcgcagcgatggcgagaggcgcgttcaaggcaacggtacgccatagttcactgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaaccggtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgctttgattcgcatgatgagtgcattgatcagccatatcagcagtatggtcaacagcaatggcgtaatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcgggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacatgcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaatacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcagaccctcggcggcggcgttgccatcgaagcgcacaacgatcggcttggaaccgccgagcttggcgaccgcttcgaggatgccgttggcgacttccacgcaggaggtgatgccgccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgttcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttcagcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccgactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcggatgtactcacgggcgatggcattgaagccgaaacgcagcttggagccttcggagtcgatgacgatctcctcatactgctcgtcgacttcgacgaccttgccgatcacctggccgatggtgatgacctcggtgccgggctgcagattgcgacggaagtcctgcttctcctgctgttgctgcttggccttcttggactgccaccacatcatgccgccgaacacgacgacgatcacgatgagcataatgtactgttccacgaaacaactccttcaaacgagcgacattgacgaaacgctgccgagtgtgcaaacaggagaaagtctagaagagcttgctgacatcatctttgggcgtaatccccaaatgctgccatgccttctcggtagccacacggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacaatcaggtcgtggacgatggcccagtcgcgtacacggcgtagcaatcggttggcgatacgcggcgtgccgcgcgaacgcaacgcaagctcatgagcggaacccgtatcaaggtttacgcccagtacgttggccgaacgttcgatgagcttttccagctcctcgtgcggatagaagtcgagatgtgcggtgaagccgaagcgtgcgcgcaacgggcttggcagcataccttcgcgcgtggtagcaccgatgacggtgaatcgcggcagggtcagcgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgctgaaccgcagggccggaagtcacgcgaatcggcacttcaagctcattggcaacgatcatggccaacgtggttttgcccaagccaggagggccggcgagcagaatatggtccggtggcacatcgcgtttgcgggccgcgtccaggaacagttgcagctgggccttgagccgtggctgtccgataaagcctccgagaacatgggggcgcagctcctcgtcgctgaccggctcgttgccgatcggctgggaggagaccatgcgcagcgactcttcgttggcaccggtgttggaggctccgtaatccgttgtctcgctcatcagcggcccctatccatcagcgccaaagccagacgtagcacacgcggcacatcgtcggtggcaagcggcgtgggaatgtcgttttcggcgcaagcctcggcaacggcctgctgggcgtcctgctgacgccagccaagcgaaatcagtccttcgacaacctgttccgtaccggtatccaccggagacttggatgttgccgcctgagcggaagcaccctcgatctgactcaaatcaatagagcccttaagctcgaggatgatcttctgtgcgcccttcttgcccagccccggagccttggccagcgcggtggcgtcgttgtcggcgatggcgtgggccaactgactcggcgtcagtgtggagagtaacgattgggccactttaggcccaatgccggagaccttgatgagttgtaggaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagcgctccaggattcaagactcgaacaactgttcgaaagtatactacatgcctcggtcgtggttgatgcggcggcgcgtggagttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgggcgaacacacgctcgatagatactgcgtccggcgcgaatcggtccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcctcaaggctcaactcgacctcgttcttcggctgcatgacctggtcggcggaatcgtagtcgaagccggcttcctgcagagccttgcgcacggtgaacaggtcggacggaccggtcacaacggtgaacacttcaccgtcatcggtaacgtcctcggcaccggcttcggcggcggtttcgaacagcttgtcgaagtccacgccctcggacggcaccacaatctggcccttgcgctcgaagttgaaggacacggagccggaggtggccagagagccgttgcccttggtcagggtggaacggacttcggcggccgcacggttgcggttgtcggtcaggcattcgatgatgaggccaacgccggcaggagcgtagccctcgtagacgatgtcttcgtagttggcggcaccatcttcagcaccggcaccacgcttgacggcgcgagcgatgttgtcggccggcatggaggccttcttggccttgtagatggcatcgtacagggacgggttgccgtccgggtcgccgccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtaatgtttccgatgattgtcttattgcgcgtaccgataaaaccggttgcgcgggtgccgcacccggtcaggcaagcggcaaatgatactgcggggccagctgttcgaatgcctgggcataggcgtctcgctggtcggacagcagaatcggcatggtacgcgtctgggcgacgatgggcatgaagttcgcatcgccattccaacgcggcaccacatgctggtgcaggtgcgcggcgactccggcacccgcgacctcgccctgattgatgccgatgttgtatccgtccggacgggagacggtctccatcaccttcatggcgagggtggtggccttctcgaattcgaacagttcggcatcgtcgagttcggtgatgaatccgacgtgacggtacgggcaaatcatgagatgcccgacattgtatgggtagaggttcatgatggcgaacacgtgcgtgccacgccaggcgatgaggccgtcttcgtcggattttttgggtccggcgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcaccctttcttggctcccctctctgaggggagctgtccgtgaaacggactgaagggagtgcgagccatgcaggactcccctcagtcgcctacggcgtcagctcccctcagagaggggagccagtaccattcacatcactcagccacagcagcgttgaagtcgtcggcggagttcacctggacgcgcttcttgatgacggtgagaatctgctcgcgagcagtgtccaccggcacaccgttgagctggctgccgtcgcggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcatcttcaagggacttgacgaagccggccagatgcggggcaaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacagagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtgagcaggctggtgagctcgtccttcatctgctcgcgggtgcagtagatgtgggagtcgtcctgggtgaggccgcgcacgcgggtcaggccgtggacctcgccggacttctcgtagcggtacacggtgccgaactcgaagaggcgcagcggcagctcacggtaggagcgctgacgcgacttgaagatgaggttgtgcatcgggcagttcatcggcttgaggtagtagtcggcgcccggcttggtgatgttgccgtccgcgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcacccttcgggtggaacacggccaggccggggccaatttcatccgggaaggagaacaggtccatctcggcgccgagcttgcggtgatcgcgcttggcggcttcttccaggcgggtctggtaggccttgaggtcttccttggtggcccatgcggtgccgtagacgcgctgcatggtcgggttcttctcggaaccacgccagtaggcggcggcggaacgctcgatcttgaaggccttgatgtagcgggtgttcggcaggtgcgggccgcggcacaggtccttccaaaccacattgccatcacggtctacgttgtcgtagaagctgagctccttttcggagatctcggtggcggcggccgggtcgaggtgtgcttccttgtcttcgatcagttcgatcttaaagggctggtcggcctcttccttcagagcctcttcctcggtcacggaacgacggcggaaggactgggaggacttgatgatgcgctgcatgcgcttctcgatgtccttgaggtcgttcggggtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccgtcttcggagtcgagggcgatggggtcgacggtgtcgccatcgttcagcggcgtgtacaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccacggtactaatgtgcaggcctggactggttaatcaacgtaggacacgataggttgggcgtgcgacaaataccaccagcatctgaaccaatacgaaaaaacctcgccgaagcgaggtttcgttgtggagcggacaacgggactcgaacccgcggtctcaaccttggcaaggttgcgctttaccaactaagctatgtccgcaaaggaatccgccgtgagaagcggaatccagtgggcgatgtaggaatcgaacctacgaccccttcggtgtgaacgaagtgcgctaaactgttagaattacaggaccaacaagggtgttgcacttctaaatagacatcggggcacagcggagtgacgtttatgggccaacggttagtcgatatcggcaatcggcgggttggcgagcagatcgtgggtttcgtggtcgccggcggcatcgctccaggcaaggctggcgaccggggtggcgttgtctgtgccgaggccgcgtccgggctcgaaggtgagggcggccgtggacgtgccgtcggcggcggtccagcggaaggtgatggacgtgtcgccatcgacctcgtagctgaactcgccatcgaatgcaggcagttcgttgcggaacttggccagggcgttcagggccttgaccaccgggcgctcgaggttttcatcgatttcggcggtggagtaatagtggcgattgatgtcgcggccgttgttggtgcggcgcaacagttccatgtcgttgcggccggcgagcgcgcccacgtagtagacctgcggcacgcccggcaggaagaactgcacggcgcgggcggccaaatagtgctggtcgttgcagccgagggccgagtagtacgtggagttgacctggtagaggtcgaggttggacgcggcggcaccggtggcggcctgggattcgccgtgggtgttggcatggatggtgttgaccaggttgtcgacgtcctcgtcgggcacgaggcccttgagggagcggtcgagctggtcggagccgatgtcgatcacgccgatgccatcgtgcgtatcgagcacggtgacggcgttgttcgggcggatctcggtccagtgggccacgggttcgacgtgaccggtgaacagcgagtgcagaagcagcggcggcagggcgaaatcgtagacgcggtccaccttggaggcgatttccacctgcttcttgtagtagctgtggacctcgatgaggatttcaaggccgcgcttgacgccctcctcgcgcagacgggagatgagcttgaacgtcttcggagtcatgaagcagctggtgccggcttccttggcgccgtagccgacggcgtcgaggcggatgtagctgacgtgagaggcggccatctggtcgaaaatcgacatgaggtattcccaacccttgtcggaatcggtgtcaatatcaacctgctgcggggtgaagctcacccagaccaagcgcgtcttgccggcgaacttgtagtgggtgaacggcaggcccggacgcggacggtagatgccggccaggtcctcttcggtggcgccgttcgggaacacggagctcatggtcagaaacatcgggtaatactcggattcctcacctttttcaagcacgtcttggaactgcttggattcccagctcatgtggttgacgatggcatcgaccatgatgccgtgggtcttggaaagttcagcgacgtcgtcccagctgccgagacgcgggtcgactttggtgtggtcgatcgggtcgaagcctgcatccgcaccatcgaacggagtgaagaacggcaggatatgcacgccgtcatacacgccgtcgaagcgggtgcgcaggatgtcggtcatcgagctaagagtgccatcgccgagacgatcggcgtatgtgatgagttgcactttgtttttcatgggacctcccttggctcatgggcgcgggtgcaatttgcgtgcgcatctgcctgtttgttgtttacgtatttgcatactcacgtatgtatcgaaccggttcgatattacctcgaaagggacgtcaatgtccagtcgcgcagtgaaatgcgcgtgtcgaaccgattagatgcggtgttctatgcagcttagcctgtccgactccaatgtgtccgattgataacgcccggtttgttgcgcattttggttgaggcttgagttgagagacatggtccgtcgtccgggtacgatttcagtcgccaaaccaaatcaacctatttaggaaggcgacggaaccatgccgaatcagattctacaggtcgacgagaacatgctcgagacgaagctggaccggttggtgtcggagaaggtcgaacagctgttgaacgcgatgctggacgcggaggccgacgagatcacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgcggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggacggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccgacatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtacatccgcttcaaggcgtccatgggcaggcatggcgccacccgcgtccaggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagccccgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacccgcgcgcaaacccgtcgaccacctcggggaggagcacgccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacaggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcggaattaaaccgacatcggtttaactcggaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctccgtgcgatcatggacgatgcgctccgcctgcgccatcgcatgattccgtacctccacaccatgaactggcgcgcatcccggacaggccttcccctggtggagcccatgtattggggatcgcccgacatcgacgccgcataccacgttcccaacgaatacatgttcggcaccgaactgctggccgcgcccatcacggaaccgatggataaatcctcccgacggggcaaggccgacgtatggctgccgcagggcgactggttcgacttcttcaccgggcgccggtatagcgcgtcttcgcccaacggacggcgcatgaccgtctggcgtccgctcgacggaattcccgtgttcgcgaaggccggcggcatcgtgccgatgcagcccctgtccgagggggattccatcaactccgtcgacaacccgcagcatctggagatcatcgtcttccccggagcggacggcgacttcacgctgatggaggattcgggacattactctcggcagatcaccccggcgaccaccgcgatcacctatcgatggcgcaaggacggcgccacatccgcactcacggtatcgccagcccagggagacgttcacgctctgccggcccggagaacatgggatttcctgttccgaggcattaccgacagcgacatatccgtacaggccgacggcgcatccgtcgattcggatcgccggtatgatgccgaaaccctcacattgcaggtaacggtcgccgacgtatccacccgcagcgagatacgtgtcaccatcggcgacacgacgatggccgccgatccccgcatggaagacgtcttcgacatccttcggcatgccgaaatgcgatatctgaccaaggaacaggcttatgccgccatagcggagaacggcatcgacgcattggccacgatggattcactcgagcacgtcagcgggccggacatggaagattgctccgattcgcatatgccgagcgccgtccgtcaagcgctgacggaggtgctgctccgatcctagcccgcatgtcgcctctcccggaatacgccacgggagaggcgacagcagcccgtcacagacccatgtccaggcgaacgccgggccgtcaacacgtcgaggcacgacgcaccagatcgtaggaggtcacatacgtgcggaacggatccgccgacccctcgatgcgcgcgatcagcatatccacggcatgtcgcgcgtaatcatccacatgcgggtcgatcgtcgtcaatccgggcatgcagtactcggcatccggcacgttgtcgaacccaatgacctgcatatcctgcggcacgcgcacgccgcgccgctgcagctcatgaatcaccccgatggcgagcgcgtcgttcaggcacatgaccgcatccggacgcggcgcatccggatcgtccaacagccccgccaccgcatcgcggccgccggactgcacccaatccgcgttacggaccagccgccaatcgacctgcaggccacgctcctcatgggccaacacatagccgcgggtacgcatcgtgctggtggtttcgggccgcgactcgcggtcggcatccgggcatgcgttctccgcggtgccgccgatcaacgcgatcctacggcatcccgaatccagcagcgcccccaccgcggtgcgtacggcctccacgttcggcatcgtgacccaatcggccagtccctgcgtatcgtaatcgcccacaatcaccaacggatacggctggtgcagtatcgtgcgatccgtgatcggcgagcccatgaagaaaatccagccgtccgcggccagcttcttcgtctccgggatcgcctgcgccaagccgccggcgctgttgtaggtatcggtgatcaccgcgtacccgcgggaacgtgccgccgccacgatgctgtcggcgagatagggcatgaacggctggcagaaatcggtgatggccagtccgatgagcttcgtgccgccggttttcatggcgcgggcggacacgttaacgcggtatccgaggcgttcgatggcatcctggacacgctggcgcgtctccgggcgcatactgccggtgttgttcagcacattcgacaccgttttgatggagacgcccgtctcgcgcgccacgtcggtgatggtcacccgtttcgccacagcacccctctcgtcgcaccatcgggcatgttccgcacggttcaggcggaacgcccgtctgattccagcataacgcgttttccccggccggtccggtcccttccgcccggcccgggaagcaagggccgtgcgatccgtccttctccggaacggaccgcgcggcccatcgcgtcacttgatgtgcagggcggtccaactcaccggcggcagggagacgcggaccacgccggactcggcatcgtacatggccgacccgttggcgtgcggggtcacacggttctggtcgtagagcgtattcgcggcgaacagatcgtcgtcgtgcagcgtctgcgcctcgacggatgccggctgcgcgccgtcctgcagcctgatctcgaactcggcggtcgcctcgagcgaacggttcaccgcaaacacggcgagcgagccgtcggcgcagcgcacggccacggcgttcacgccgtcgacctcgccatagcgcggcgtatccacggtgccggcggacagcttcggctccagcacggtgccgcccttggccaggcgcgcggtcacggagaacgggtggaacgtggtctggcgccaggccgggccgcccggctccgtcatgatcggggcgatgacattgaccagctgcgccaggctggcggcgcgcacgcggtcggcgttcttgagcagcgtgatcatcagatcgccgaacaccacggcgtcggcggcggtgtagatgtcctccagcagacgcggggccaccggccagttgccgatgccctcgggggtcttgctcggctcctcaccctggtaccagacattccattcatcgaacgagatgtacacgtcgtgcgcgctcttcagatgggccttggtggcgtcgatggtggcggccacgtccttgatgaagccgtccatatccacgccggaggccaggaagctggccatgtcgcgcgtgccgtcctccttgaagaacggctggtagtaggcggggcaggagacgaagttcacgttctcgtaggtcttctcaagaacggtctgctcccacttgccgaaggtcggcatgccatgggcggaggagccgcacaccaccagttccacgtccggatcgatctggcgcatgccggcggccacggaggcggcgagcatgccgtagtcctcggcggacttgtggccgagctgccacgggccgtccatctcgttgcccaggcaccacatgcggatatcgaacggcttgtcggcgccgttggcgcggcgacgttccgacagctcggtgccgccgggcacgttcgcgtactccagcaggtccagggcctcctgcaggccgcgcgtgcccaggttgacggcctccatcagctcgttgccgccggtggcctcaagccattcggccatctcgtgcaggccgaattcgttggtttcgctggaatgccaggccagatcgagtcgacggggacgttcctgcttggggccgatgccgtcctcccagcggtagccggacacgaagttgccgcccgggtagcggatggtggtggcgccgagttccttgaccaggtcgatgacgtccttgcggaagccgtgctcgtcggcggtcgggtggtcgggctcgtagatgccggtgtacacgcaacggccaaggtgctcgacgaacgaaccgaacagacgattgttgaccggagcgacctcaaaatcgtcatcgacgacgagacgtgcggtcagatggtcctgctggggcatgggattcctttctacatatctgcatgcactctgcatacgtgacacgtatccatacaacgatgtaccgcggaggcgcgggcgaccggggacatccgtgtgacagccaccagtgtagtacaaccttgtactgactgccggaagacgtgtcgcagagacggctgagaccttttggcgcaccactgcagcaaaaaagatcccaagaagtcgaattacagtcccatccgacgcatagccaccgtgaacatacggcaaaaggcatcaaccacgtcacccgtccacccgctacattcacaagcagtaccgcccactctgcatcattcgcatatgcaaaggccacgaaccgtacgatgacggttcgcggccccctgacatgccattaggccacccggctcgcaccggctgttcagcctgccggctcagccctcgcgcttgggcgcctggctggccacgcgggtcaggcgcggcgggcggcgcgtggacacgaacagcggctgcacctcgaccagcgggttgtacggcgccaggccgaaccacttgaccggggaaccggccacgcggcggatcgcgtacttgatctgcagcgagagggcgccacggccggagaccttcgactcgggcatcagcgccttgtggatcaccacgtagcggatggtgccgatgccgggatcggcgtcaagcttcgggtagatcgactgctggttcggcagctcgccggtcttctccagatcgtgcatgatctgatgcaggtaggccgggatggactgcgagaccttgaagccgaggcggatgcgcacacggaacaggtagtcggtaccgaagctctcgaccgaatactcacgggtgaacggctcgtcggtggtctcgacggccaccgcccaccatgcgcgggcgcgcttggggtggtcggcgaagatcgagaagaagatgtccgtatcgagacgcttcaggtccggatcgctggtcaggtagacgatgttgtccgcgaaccggtggatgcggctatcgccgtgcagcttgtccagcgcggggaggaagtccttcggcatcatgtgccgacgctgcgagcgctccagcttggtgccctcgttccacgtgtacatgatcatgaggatcgccagcgtgagcagcagcgtgaaccagccgccgtgcaggaacttggccatcgaggcggcgaagaacaggacctggatcgccaggaacacgatggtgaacacaacggtgccgaacttgttgctgcggtgccacaggtagatgcccagcaggatcgtggtggtgatcatcgtgatggtcagtgccaagccgtaggccgccgagatatgttccgaatcgcggaacagcagcagcacggccagcgtggccacgcacagcaccacgttgacgaccggaatgtacagctggccgcgggtacgggcagggtaacggacctgcagatgcggcatccagttgaggccggtggcctcggagaccatggtgaacgcgcccgtaatcagcgcctgggaggcgatgatgccggcggtgaccgacagcacgacggccacatagcgcacgttcggatccatcatctggaagaacgggttgatcccctcggcgtcggccagttcggggttgttctggttgcgcagcatccacgcgccctggccgaagtagttgagcaccagcgccaccttgatgaacggccaggtgaagtagatgttgccgcggcccacgtggcccatatccgagtacagcgcctcggcaccggtggtcgaaaggaacacggtgcccatcagcgccagaccggtggcgttattcggactgaacaggaacttgatgccgtagtacgggttgagtgcggcgagcacggaccagtcgttgccgatggctaccacgccgacgatcgccaggaacgcgaaccagaccatcaccaccgagccgaagaccttgccgatcgattcggtgccgcgcgactgcacggcgaacaggatcacgatgatcaccgcggtgatcatcatcgtcagatccttgttctcggtgaacagatgctccaacgccggcagcgtcttcaggccttcgacggcggacgagatcgacacggccggcgtcagcaccgagtccgccaggaaggccgcgccgccgagcatagccggtatgacgagccatgcgccgtatttgcgaatcaacgagtacagagcaaagatgattctgcagaaacggacatccaaacatcccaattcacatcacacatgaccgattctccagaatcggacacacagaacacatttttcggaactcagacgtccgattcggcagaatcggacacatgtgcacaagtcgaatgatgagcacgactatcgacgggcgttcgccggttgtggacgccgctgaaatcgatgcgatccacaccgggcacacgcatgaagacgcacagtatcaacgcgtggtatcgcctggcaccagtgtcatgggaataagcacgttcggctcgaacggcttggggatgttcttgcgtgaagcgttagccgcggccacttcctcattggcaatcgcctgcacgatatggtcggccgccgactgtgcgatcgccgagaaatcctgcgcgaccgcggtcagcttcatgccggccaaatcagtcaaatacgtaccatcgtaggcaacgatctgcagctcgtcaggaatggaaattccacggcccaacgcttcgcgcacgcagaacgatgcaccaatatcggaactgaccacggcatcgacgccgtcggtcgtcaccttgtcgagcgcattgctgaccgcacgatgatagccggcaaaatccatcacttcgccagcttcaacatactcgtatttcacgcctgcggaggtcaattcctgttccaacgtgaggtagtagcgcaccgtcgggaacgtggtctttcccaaatcgaacggtccttcctcgacttctccgcgcgcagccaaatcgaagaattgatctcgcggaccgccaatcatcaccacatgtttggcaccattgcggatcagcatctgcgcaatcaatcgcccaccctgctcgtggtcggatccgattgacgaaataccgtctccaagcacacggtcgaacgcgacgatcgggcgatgaatcgacgtccaataatcgccgggatgcgaagtgtgcgcacacatgacgatgccgtccatcatgtgccgacgcaacatgtcgacatactggatttcgccatccgcctcatctgcggtagagcacagcatagtgcgtaatccttgcgcggcgagtgcatgctgcagatgtgcggtaaacgtcgcaaagaacgggtggcggatggtgggcacgatgacgccgaccagattcgtgcaatcatgatacagattgcgggcaagctcgttcggcacataattgagggcttgcatggctttgcgcacacgttcgcgcatgtcatcagacacgtacccgttgccgttcaccaccagcgagacggtgctcagagacaccccggccttcttcgccacatcgcgcatgccgaccatgatcgcaccttccccgttatcactgttctatcgttgtatgctcacgtgcttaccacgaaatattacattcatttacattctctcgaacctgttcgacagtccggcaacgaaatacagcttcttagtgtcgactcctgcggaggcgaaggccttcagcagcggcttggtctggtcgaatgcaatcaccagcgttgcatccggactggcggccttgatggcggtggcgctcagatttctttcacgttactcagcgaccgtccgtgtaacgtgaaaattacgccggattggcaagcagcgcaatgccgaaaccggcggccacgcaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcgattcgttcttcgattctcgcggttccagccttgttgaattgacacgtcgagcacgtaacgggccatggctcccagaccgccgaacagacagatcatccacatcatcagcgcacctccccggtagtcgggtcggcgacaagcgaaatctccgcagtgatcggtttgggctcgaagctgggtggaagcgggttggccggctgctggattggctgcgactgctgctggggctgctggattggttgcgactgctgaatcggctcgggcagctgccccaagtctgaagtatccggctcgcgcaacaacggctgcgatgactgtgtcagctgaggaacgaccagcggaggaatctgcggaacgcggcctgtctgcataggctggctggcggtcggcggcacggttggtgtttcgactcgcggaacctgtcccgtctgtgcaatctgctgggccgtctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtactccgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccgccgagcaagccgagcccaacgccacggctgacaacctgccgcacccggcgacgcagccacgaagcggtcgccatgaattcggtcagcatcgcgaacaggaagcaggcgaccatattcgacacaaacgtgcccacaacgaatggcgtcccgctgaccgacggcaggagcatatccaacgcatgccgacagccgactccaacaaatccaccgacgaacaccacaacatacatcagtccgtcggcgagcggattgaaccgcgcctgcatacgtttcatcggcgccaggggaatcgtaggcggatccatggtgttagcggcgggcgcggttgcaccagcatgcatcacctcaacagtgtcgattgcctgcgtgatgggatgtgagtcctcacccgcagtcaccacgtctcccggcgattgttcttgcgattccattgcgctcccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcgtacatccagagtccagccgaattcagccaggctcagtcaagccgggcatcacacagccgccgcatcgcaggtcgcacctcgcgctcctcctcgccactgaacagcaccaccagatagtcgccggcacgcagccgtgtatcgccgcgcggcacgatctcgctttcgccgcgacgcaggccgatgatcaggcacccagacggccaacgcacgtcacacacccgcttgccgtccgcaatcgctcccatttccaatggcagttccataatgccgctgcccacatggcttgcgatcgccatctgcatgccttgcgcgcgcacgtaccgctccagcaactccccataaatcggtttggtgcgcagcaaatcggacaccaacagcgcgatgaaagcgacggccgcgaccggcagcatgtgcgtcaacgttccagacatctccacagccaacagaatcgacgtgatcggcgttttcacggacgcggcgagcgtgcccgtcatcacgcacaccgcaaacaccgccactgcgtcggatggcagatcaccgaatcgatgcaacacttcaccgcagatgccgccggccaacgaaccgaccgcaagaatcggcatgaaaataccgccaggcgcgcctgagccgaaactcgtggatgtgaacagcatcttcgccacgaacagcagacacagcattcccaagccgacgcgcgcatgttcggcggtatcaatcagattcgagccgccgccgagcacatcgggcaaccagatgccgacaggcaacgcgatcgcaatcgcaatcatcgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccgaaacagtattttgagacgaaatcggcggtcagcgatgcggcggtggcgcccatcagaatcgcaggggaaaaactccgatgcaccccttccaaagcgaacatcatgccggacagcggcgcgctgaacgcggcggacaagccggccgcggcaccggcggtgaccagataatgctcctgcatgtcctcacggcggcggccgcgcaaacggtgggacacacactgcgcgcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccagccatcggctccttgccgaccatccacgcgattgctagcgcggccgccaccgcggcaaccgcccacggcgcaatcagccacggggtctcgcgaatccgcgcatatatccaacgggacgcatccgtgccgtattcgatgccgagacggtatacgacaaccagcaatcctgaaaccagaccaatgactatgccggccgccgccatcttccacttcaagtggtcgaatcgcggaatcagccggcggatatcatgtgccgcgtcgttaccagtcaagccgggaaattcgttgcagacggtcagtcgaccagcgaattgatctggatgacatgatcgcgctgcggaccggtgccgatcgcggagatacggcagccgctcagctcttccaaacgcttgacgtaggcctggcaggtggcgggcagctcgtcgaaggagtggcagtcggagatgtcttcgtcccagccgggcatggtctcgtaaatcggcttggcggcggcgaaagcggcctgatcggtcggcatatcgtcgtgacgttcgccgtccacgtcgtaagccacgcagatcggaatctccttcaggccggtgagcacgtcgagcttggtgagcacgatgtcggtcaggccgttgacctgggaggcgtaccggttgacgactgcatcgaaccagccacagcgacgcgggcggccggtggtcacgccgaattcgtggccctgctgacgcagccattcgccggactcgtccagcagttcggtggggaatgggccttcgcccacgcgagtgacgtaggccttggagacgccgactacgcgggtgatcttggtggggcccacgccggtgccggtacaggcgccgccggcggtcgggttggaagaggtgacgaacgggtaggtgccgtggtccacgtcaagcatggtggcctgagcgccttcgaacagtacggtcttgccttcgtcaagcgccttgttgagaatcaggccggtgttggccacgtacggcttgaggcgttcgccgagcttcagcagctcctcggtggtctggtccacgtcaatcggacgacggttgtagagcttgaccagcatctggttcttctggtgtaggctggcctccaccttgtcgtgcagatggtcggcgttgaacaggtcatgcacgcggatgccgacacggttgatcttgtccgcgtaggccgggccgatgccacggccggtggtgccgatcttgtgcttgccaaggaagcgttcggtcaccttgtcgagtgtgcggtggtagggcgcgatgatgtgtgcggcctcgctcaccttgaggtgggagcaatcgatgccgcgggattccaggccgtcaatctcctcgaagagcacttccgggtccacgaccacgccgttgccgatcaccggggtcaggttcgggttgataataccggagggcagcaggtgcagggcgtacgactcatcgccgaccaccacgctatggcccgcgttgttgccgccgttgaagcgcgcgacgtaatcgaccttggtgccgatcagatcggtagccttgcctttaccctcgtcgccccactgagcaccaataagaacaattccaggcatgatgcacctccgcattcgcacgattccgccggaaacagactaccgtacgccctctaccctgcgaagtttcgtctcacgcagggcgaggctgggggtgcgacgacccggaatgggtgacgaatttctactcgtacgaggcggcgctgtgaccaatcgcacaagcgcacaggttgaagaacggggcctagcgggcatgcctcgcgcgataatgaagccatgacgatcgcaacaccggaacgctatgccgaaatgctcgatgccgcccgccgaggcggttacgcctatccagccatcaacgtaaccagctcacagacgctgaatgccgcgttgaagggcttcgcagacgccgagtccgacggcatcatccagatttccgtgggaggcgcggcctacgtctccggcaggggggtcaatgatcgcgttaccggctcgctggcgctggcggctttcgcacatgaagtggctgcgaaatacccgaacatcactatcgctctgcacaccgatcactgcgccaagcagtatctggatgagtgggtgcgtcctctgctcgcgcatgaggccgatcaggtggcacgaggccaggagcctacattccagtcgcatatgtgggatggctccaccgtgccgctcaaggaaaatctggacatcgccgaggaactgctcgacaagtcgcagaaggcgcacaccgtgctcgaaatcgaaatcggcgcggtcggcggtgaggaagacggccactccgccgaaatcaatgaaaagctgtattccactccggaagatggcctcgaagtcgcccgccgactgggtttgggcgaacgtggccggtacatggccgctttcacattcggcaatgtgcatggtgcctacaagcccggcgtggtcaagctgcgtccgtcgctactcggcgacattcaggcgcgtgtggcgcgcgcggtggccgaaggcgagttgcctagcgcggccggcatagtcgatttccccaacggcaagccgtttgagctggtgttccacggcggctccggttcacgcccggaagaaatcgccgaagctgtaagctacggcgtgatcaagatgaacatcgacaccgatacccagtacgccttcacccgtccaatcgccgaccacgtgttcgagaactacgacaaggtgctgaagatcgacggcgaagtgggcgagaagaagttctacgatccgcgttcttggggccgtaaggctgaggattccatgtccgcccgcgtggtcgaggcttgccggcagctgggttccgcgggcaaagcgctcaaatagcgcgtagttttgcgatcgtgcgcgacactttcccggaaataatgaaaatcattgaaaatcaatggagcggacaacgggagtcgaacccgcctctaaagcttgggaagctttcattctaccgatgaactatgtccgcatgccttacggctgctgcacctcacgtgacgagcatgctcagccaaacgaggtacgagtagttatcctagcacgtcacctgccgacgcgcgtggagtaggtgggcggagcgatcggcgtgccgttcatttcgttggccatctgcatgaggcgcgcgatgcgctcatcggtcggcggatgtgtggagaacaagcgcgagaagccgaccgcggagaacgggttggcgatcatcattgcggagacggactgggtgccggcggttttgcgcatcggcgtggtctgcgcgccgtaggaaatcttgttcagtgcggaagccagggcctcgggatcgccggtaagcaggctgccgtcttcatcggcgtcgtactcgcgggtgcgggagatggccatctggatcaaagacgcggcgatcggcgcgagaatcacgctcagcaatgcgccgatcaggccgaggccaccggaactgtcgcggtcgtctcgcgaaccgccgccgaaatacatcagcgaatagcctaggtaggagatgacggtggccatggcagaggcgatggcggaagtcaggatgtcgtggttgtacacgtgcataagttcgtggcccagcacaccacgcagttcacgggcgttgagaatctgcaggatgccttgggtacagcagacggccgcgtgccgttcgttgcgcccggtggcgaaggcgttcgggctcatggtgggggcgatgtagatgcgaggcatcggcttgccggccttggcgctcagttcacgcacaatctggtagatctccggggcttcctgctcgctgacttcccgcgcgcccatggaggcgatggcgagtttgtcggagaaccagtaggtgccgaacgtggtaatcaggccgatgacgatatagatgctcagggtttgccgactgccgcccgtggcccaccaaatcagcatgatgatggcccacatcagggcaaacagcagcgttgttttcaggccgttgaaatggccgtgcacccgtactttggcatccataatgcacacactaaaatcgcaggctgaatgattgctggatatgcgccacgcgcaatgtcccatattcgcccggcccgtccggccccgagcccggccgcgtccgcacggggcgcggccgggtggacgaataccggacgggcgtgggcgaacgtcaggccagggcgagctcacgcatctggtcgggctcgatgaccttcttgtgctcgcgaccttccttggcgccctcggcgcgctcgaaggcgtcgaccttcttccagccggcgaagtcgatcgggcgaatgccgcgctcggccagcagtcgatcgatggattcgggggcgcggtcggctgccacgcggccaccttcagcggccttggccagatcctcgagcatgttggtcacgatggcgagcgcatcggacttggtggagccgatcaggcccaccgggccgcgcttggcccaaccggtggcgtacaggcggtcgcgcacttcgccgccgtcggcctcggtggtgatgcggccgtcgccgttggcgttggccaggtgggcgccgtgctcgtcgtaggcaatgccgggggcttcggcgggcttgtaaccgatggcgtggtagacggcctcaaccgggtagtcggtgaactcgccggtgcggcgcatcttgccgtcggcaccggtttcggtgcgctccacgcggatggccttgaccttgccgtcctcgccgagaatctcggtgggggcggagttgaagtgcacgtagtactttcggtcggccgggttgccttcgaagtcgacgtcgccgtcgtcttccatgtcttcggccatctcgcggatggcgaacagctcctcgaccatctggcgggtgagcttgtccttgccggccacctcgatggtctcgtcgtccagatcgaagtcgtcctcgttgatgatgagctgcacgccgggcagcttctccatctcgcgcagttcctgcacgctgaacttggcctgggccacgccacgacggatgaacaggtgcagcaccttggccttgttgcggccgatgccctcgtacacgttgtcgggaatgtcggttctggccttgaggtcgtcggcgtcgcgcatgagctcgcgggccacgtccatggccacgttgccgccgccgattacggcgacgttctcggccgtaagcggccattcgcgggcaccggtggggtagccgtcataccattcgacgaacttggcggcgccgtacacgccttcaaggtcggcaccgggcaggttcagcggcttgtccttgaccgcgccggtggcgaacagcacggcgtcgtaacgggcgagcaaatcatcgagggttacgtccttgccgaattccacgtcgcaatagaggtggatgttcgggttgtcgagcgtcttctcaagcgcggaggcgatgaacttgatggacgggtggtccggggccacaccgtaacgcaccaggccgaacggcaccggcagcttctcgaacaggtcgatgcgcgcttcggtgccgaggccgagttcttcgcccagcttcttgagctggcgcaggaagatatcggatgagtagacgccggccggaccagcgccaattacagcaatgcggagttcagtattcacagattcagtcacgcgctctagcctaacgcaaagccttccgttgcaacagagggcgagtggtgggaattctgtgtattaggccatagtttgtgcgtttgggaaacctacgagcactgctaatgtcagattatgggtttccctattggtcaagttattgccgttctcattccaagaagcatgcaaggcggatcaggcccttactccggatacgtttatgctgcaaggcggttatccacgcatttatgacacgagaatgccgctcaatctgttcttctcgaactacatcgacacttatatcgaacgtgatgtttccgaatatcttgatgtacgcaatttggctgaattccgccgattcttgactctttgcgcactcagttccggagcactcataaactacaccaacatcgccaatgaacttggtgtaagtccgcgaaccgtaaaggcatggatgtcgattctggaatcaagttacatcgcattccatctcatgccgttctacacgaacgcacgcaaacaggtggtcaaaacgccgaaactctatttttatgacactggcttgctgtgtcatctcttgggcattcggacggtcgaagcactggttgcgcatcccaagttcggcgatatatttgaaaacctcatcattgcggaaaccatgaaacagcatttgaacgccaatcaggagccacaattattcttctaccgcgatgccagcaaggtcgaggtggatttgttggatttcaccgatcctaacaaccgtatgctcatagaaatcaaatccggacaaacctatcatgaccggttcgcccgccatctcactttaattggcaatgttctcggtataccgtgtgagcaacagtacgtaaccagtcgggttgagcatagttatgtctcacaaggaatccgcgtcacctccacccctcgattggctagaaggccgacggtaaagagccgccgcagagcagtaggaattctgtgcaatcagtgaatcccttgaggcattaaagacgtcacctccaacggctctttacgacctcgattgcattcattaggtcatttcttcgtccattaggtcggagggtgctgaagccatcccttggaacggcggggtttcaagggccgctccgaccaaggaccgacctaataaacgtcaaatcgacctaatgaataactccgatgctattgctgctttcgtgggtgggatttccgtttccgccacgtcaccaaccgtatcgccccgattatgtttcgatgcggtggactcgacatacgaccatcccggtcagtcaactgacctacaaaaacagcagaagcctcatattcttaatcagtcccgatcaattagggcagtgagggcccagaggatgctcaccacgtcgatggcctcctggaggaaggcaccgacgacgaccgggataaggttgaacgcggcggcaatcatgccgatggtggcaagcacaaggcccgcgattacggcttgaagcatcacgcgcttggtgcggcgtgcaatggcgatggcgcgcggcacggcggcgatattgtcattcataatgaccacctgagcgctttcggaagcggcggtggacgtgccatcggtcatggccacgccgatatcggcaacagcgagcaccggggcatcattcacaccgtcaccaaccatcatcgtgacggttttgccggctcctgtagcggccctgactgcggctaccttatcctccgggaacagttcggcgtgaacctcgtcaatgccgacttcgctggcaatgatattggcggaagcccgcttgtcaccggtaagcatggcgagctcggtgacgcccaactcatgcagtttggcgagcactgccttggcgttggcacgcggcacatcgcgcagcacgatgcgcgcgatcagccggccgtcaacggacacatacgacgccatttcgtccggctgaagcagcccaaatcgtgtgcgcaggtcatcctcagaccgactgggaacagcctcgccgaccgccaggaatccatcctccccagcagccgcgaaagacagccggccaacgcgcaccgcgtgtccgttcacctcgccggaaacgcccttgccggcgtcttcattgatgttcttgacgaccggatactcccggccatggccaggccagctggcctccggctctgggcacaggcgctggccatcctcgaaccgctggcgcagtcgggccagcgcctccgcgccggccttggcaatgcctttggacaggatgtgcaccgagtagctttccaccgcgccggccatcatcagcacatggtcttcgttgagacgggttgcagcgccgggcaacatctcgacgcgcaccacctgcggctgcttgacggtgagcgtaccggttttgtcgaagaacacctgcgtgacgcggccaaggttttccagcacgtcctgtgctttgataagcacgccggctgcggcgaggcgtccggttccggcgatgtatgccaccggtgcggcgatgagcagcgggcagggcgtggccagcaccagcacctgggcgaatcgcgtcggtaccccggacaccgcccatgcgacgccggcaatcaccaacgaaagcacggtaaagggcacggccaagcggtcagcggtttttaccacggccgggcgcgactcctgcgcggaggccacgagctcgaggatgcgctggtactgcgaatcggcggccacctgggtggcacgcatggtcaatgcagtcgagccgttcaccgccccggacatcacacgggcgccggcgaacacttcacgcggcaccggctcaccgttgatattgctcaggtcgagcgtggccgtgccggacagcagctcgccgtcaaccggcacagtttcgcccggcaacaccatgagtacgtcgcccagctgcacctgctcgaccggcaccgtgtcgaagcggtgcgcggcggcggcagccgatgccaagcccacacgccggaagccatcggacgaatcgcccttatcggcagcaaacccacgccccacgccaggcaggttgacgacgtgcgcggtttgcggcgcggcctccatcagcgcggtcaggctgcgctcggccttggcttgagcgtattcctcaatggcctcgccggacgtgatcatcagcgtcaccgcccaacttgcccagtattcggcgacggccacggtggagaggatcgcgaccacggccagcacatcgactccaacctgcccatgacgcaaatcgtcaatcatgccgcgcacagtgtcaatcacgataatcagcaccagtgcgataaccagccactggccgaagcccggattgccgagtaccggaatcgccatcgcattgtcccacggacgccaatcgcctagtaaagccaacggaattgcggcgatgacgacgaccggaagcatcggcacaagcttgcagatgtcgagaattttggtgaagaatctgatgagtctgctcatcattgctccttacgctcgtatacggagtcgattgcggtacggcaagcgtggcccgcgcaatcggcgctacggtcacgccttgttaacccaccggcggctttgcctggggcttcgctttgctcggctcccgcgcaaccttccgatacacggcgtaaagaaatgtattcagttttgtattgaattatgcgctgtgttcaggacgtcgcccgaactcagtgcttggcctaccctatcaacgagcgttgcgcgacatgccggatatcgaaactgcgttggcggcatgggcgcggggcacaatcgcgcatacgaaaggcccgtggcaggagtttgctcactgtcacgggcctttgcttgtccgacacggtgttcagcggttaccgctcaacaccgtgtgacgttgtcgagtcggctttaccacaggccgaacgggtcggagaagccgccgccgtcaccggtgccgccatcgctgttgccattgccattaccgtaaccgttctggccattgccgttctggttgttctggttattctggctgttgccgttggaatcggagccggacgaaccgttcaccgacgactcctcctgatcgagcgtcacgtccatattcatggtcttgccgtcgcgcacgatggtcagcgtcaccttgtctcccaaagccgcggcacgaacgtaaccaagcagcgagtagttgttgttcacggcgttgccgttgaaggccacgatggtgtcgccctccttaaggccggccttgtcggccgggccgccggagacgaccgcgctgccggtggcgctggacttggtgatggtcgcgccgccgcgggtcacgccgtcggcttcaaccgtgtcggacttgatgaccacgccgagggcaacgtgcttgaccttgccgtccttgatgatttcgtcggccacacgcttgacgaggttggacgggatggcgaagccgatgccgatggagccggcggagtcggaggaggtggcggtggaggcgatcgaggagttgatgccgatcacctggccggccgcgttgaaggtcgggccgccggagttgccggggttgatggccgcgtcgatctggacggcgttggtgacgatctcgttgttgttgtcgtcggtcacggtcaccgggcggttcagggcggagacgataccggtggtggcggtgtcgtcgtagccgagcgggttgccgatggccatcacgttctcgccgacggcgagcttgtcggaatcggcgaattccacggccttgaggtcgctcggcgggttgtcgagcttgatgaccgcaagatcggtggtggcgtcagtgccgacgagcgtggcggaatacatgttgccgttggcaagcgtcacctgaatctgctgggcgccggagatcacgtggttgttggtgatgatgtggccttcggtgtcgatgatggcaccggagcccttggcggtgccgttgctcaacgcggtctggatggagaccacggagccggagacatcgctggcgacggtctgccagtcgggggcttcgccgctcttggcggtggcggacccggagccggacttattcgagctgacgttggtaagcgagttgctggtcggcaaggtgatcaggccgctggtgagggcaccgtagccgaggcccaggcagagggccgcagccagaacggcggcgaccacggcgatgaggatgttgctcgccgtcttggacatgccctgcttggcggggccgggctgaccgggctgaccgggctgtcccggctgggtcgggccttgaccgttcggcgtaccggtaccgggagtgccgaaaccgaacagaccgccctgctggggctgctggccattctggccattctgaccggactggctggcaaacgggttgccgttgttctgctgcggctgcgtgggcggattgaacggattgccgttgccctgcggctgcgggttattggtgtagtagggattgcggttgccctgctggccctgtagggtttgctgtgcaggctggccgaacgggaattgctgcgtgggctgggcattgttgccggcctggccgccctgctggccctgtgcctgagtcggggtcggcccataagcgccgtattccggggccggacgatacagcggagttgtggccgaggtctggtctgcggccggcgctgccggagaagccggcgaggaggagaccaccgtactctcgcccttggcggaggcgtagtccgggatgggctcggtggcggcagtgtcggtagcggcttgcgtaggctgctgatcggcagcgagggcggccgaggaaaccggggcttgctgctcgctggaatcgctggcgttgccggcatcaaccgagtcgccacccacaaacgggttcttcggctcggcgttgccggtatcggcagtactattggggttttcgttattccgcggggtctggtcgacgccctgcgggttaaattcgtcagccattgctgctccttttcctgaattcctatcacgtctgttcggcggctattcgggcacttgcccattgccacttctcgtgtgctacctcagtagtaaaggcagtcaatctggaggttttctgaacgttgattgaaagtctatgcgtaatcatcgcagagtcttatgggcatctcggcttcgaggggctgatttcctgtttcgggaacatctacttgcacttcaaggggctgttcgcgcggtcaattccgagtatcaagggccctcatttaacgccattccgccatttttgcagccggcctacttgaccgggagccccttgaagcggaagtagacgttcgggagcggcgaaatccgcccctcgaaaccgagttcttcacaatttccggcccttttctggcccttctgcctaaagtgaacatatgacgatcagccttcttgaacatccgttgggcgcacagcccggacagcccggcgaccgcagcgccttccatttcgaaacgatcacccgcctgccatccacggccagcgggcttgggcgagacggtgcccgatacggccgcaccggcatcattcacacgccccacggcgatattcgcacgcctgccttcgtgccggtgggcacgcaagccgcgatgaaggccgtgttgcccgagcagatgaaggatctaggcgcacagtgcctgctggccaacgccttccacctgttcgagcgcccgggcgaggacgtgctggacgcggccggcggcttggcgcgtttcatgaactgggatgggcccacgttcaccgattctggcggtttccaagtgatgtcgctgggcgtcggcttcaagaagacgctggcaatggacgtgaccggcatgaagtcggacgacatcatcgccaagggcaaggagcgcatggcctgggtggatgaggacggcgtgacgttcaagtcgcctttgaatggtgacgcacatcgtttctccgctgagatttcgatgggcatccagcacaaaatcggcgcggacatcatgttcgcgttcgatgaactcaccacgctgatgaacacccgctcctaccaggaggattcggtggagcgcacgttccgctgggcccgtcgctgcgtggacgagcaccagcggctgacggctgatcgagtcgggaagccgtatcaggcgttgtatggcgtggtgcagggcgcgaattacgaggatctgcgccgacgtgcggcctcgcagatcgcctctctggacttcgacggcgtgggcatcggcggcgcgatcgagaagcgcatcatcggcgacacctgcgcatggatctgcgacgcgatgccggaaaaccgcccacgccacgtgctgggtatcgcctctgtggacgacattttcgcttgcgtggagaacggcggcgacaccttcgactgcgtggcccccgcacgctgcgcccgaaacggcgcgatctacacgaggtcgggccgatacaacatcaaacgcgcccagcacaagttcgatttcggcccgctggaggaaggatgcgactgctacacgtgccgtcactactcgcgcgcatacgtcgaccacctgcttcgcgcacgcgaattcaacggcttcacgttggccacgattcacaacgagcatttcttcgtgaagctgctggacgacatccgcgcctcgatcgacggcggatactttgatgagttccgcgacgaagcgttggcccacttctacggcaacggcgagcgccggccagggttgtgagtttttctccttcgttgcggcttgtgctgctacgaagtgactgaggggagtgtcgccaccgtcaaagatcacggcacccgcagaagacccacgagcgatatatccctgccgcccatgcgacacgccgaagattgcatgattacccagccgggtgtaagttagtcgattgtctgcgagtgtggcggaatggtagacgcgctgtcttcaggtggcagtgagtgtatgctcgtgggggttcaactccccccactcgcaccagcaactaaagggctggaaccggaaggttccagcccttttgctttgtccgggcaagcgccgtttttcaagttgcgatggccttgaggggggcttaggacttgagacttatggcccaactttcgtggcggaaaatgtcccggtacctgcatcaatcgtttgacgttcaagccaggccagaatccgctgtcccggttcgcgatttcgggcgatctttgcaaaccgggacaatttttgttgccccggtataaatgtcaatcgatttatgcgaaaaccgggacaacgtgccaattccagaatcggccttattccgccgattccgtctgccagacgatatgagttgaggaaaccggagtgtcccggttcacgaaaacaagccgaaatcgccgaccgggacagcggattctgccccggtcgacaggtcaaacgattgacatatgaaccgggacaaatacagatcagagagaagcccatgaagtagatttaactttcctcaactttccgtccgccataaactagcattacatagcatcatgaaccgagacgaaatcaacgaagcatttggagtcaccgacgaccagctcgaccgaatggccgagccgtacgaatccgacaattggcagggcggtgtcgggagcatcattcgcagcaatccgaaatcaggaaccagcacaagtcggaccccagcagacacgcataatacgagttcacagacttagcgatgcattccgcaaccgtaccaccgaataccacaccacggaagaactgtaagcattacgaaatcaaccttgattattgcgcgggcctatactaggttacggcagcgtaagttagtggccgggagagcgtcgccggccatagcgaggtgatcggtatgagcgtttccatcaacacgccatctggacgaaccatggcttccgccgcaacagttgtgtcttccacaaccgcgagtcaaaatccagcgcaagcaccagccccaccgcactggatcgcgcatcagctcagtacaggggccgcgcaatcgcgctatcgccaagccaaggcgcgttgaaggcgatcaagcgccagatcgtccccgttgatgcattcggcaatcgcaagccgcgactgcgcggatgactgcacgtcgtgctgtgcggcatcgattattcgaacatcttcctcatcatcgccggcgcggtatgctttgcgctacgcaagccgaaccccgtccccggctggttcgagtttcacgaggtgtttcacttgggcacggtcatcgggtatgcctgccacgtcgtggcgatttatctgattgtctgcgcgctgtaggttcgctcgcccagcaccgaggcggaccttcatacgttacgagataggtccttgaccagccagccgtgacgaccgccttcatagacctcgtcagtgagccggtagccgcgctgttcgtagaacttgtagtggtcgttttccgagtgcacggcagccatggttccgccggcttgcgcgatgcagcgttcggcgtcggacagcagccgcgagccgatgtgcctgccttgcgcttcggtcagcaccgcgagccgcgcgatgacgtatcgcccgggctggtcgggatggtcggggtccgcatagaaccggcaagtcgccacggggcgattctggtcgggctggccggactgaatagacgaggccgattgcgcggacaggccggggcgattgggcgcatcgttcgaatcgaacgccagcagatgcacggacacggcatcccattcatcgaattccggccgccagtcgcgttcgcggatgaacacctgctcgcgtatggcgcgggccgcgtcgggcagccggtcgtatgcttcgattcatatggtcatgagcgccagtgtaatgcgtcacgataaccgacagagtgcggcttgatggacgagttctggcccaggtttggcctgtgctcgatgagctcaggccgtacgcgcgatctgcacggcggtgccggacgcggtgaccatcagcataccgttgtcggcaccgagcacttcatagtcgatgtccacgccgaccacggcgtgcgcgcccatcgcctccgcgcgctgctgcatctcggcgatggcctcgttgcgggcgcgcatcagctcctcctcatagccctggctgcggccgccgaacatgttgcgcaggcccgcgccaagatccttgaacatgttcacaccggataccacttcgccgaagacgatgccctggtagttagtgatggtgtatccgtcgacggacggggtggtggtgacgagaatcatggcgaggctcctttggcttgtctgcgtggatgaatcactgccgagagtcggatcgctcccgaatctcacctcggaaacggatcgcttctcttggctaccacaatagtcgagagcgccttccccaacatcttcaatccacgcgattgcgtaatcaaacacatgtttcgcctccaaaaaatgctgatagacattgggccgcaaaaggccagcctcaacgggcgcaagccgctcaccaaactgaatcgcagacccaaatgactcgtcatgggcaaacggctggaccacccaaattccgctgcgataatcaaccatcaccgaaagcccaggctgctccgtcgatacgaccatcatcgaaccggacacgttctcgacattgatattcgggtgcccgtacaacgcgtaactcaaaccatcatcggcaacaccctgctcttgccaattggcgcctaagcactccaacatctcgctgggcgagtacgcacaatcttccgcataatcaatcggctgagcatccgtataacagcattcaccgccgtcaccttccgcaatgctgcgctccacaagataggccatcacatccggcatctcccaataatcaatggacagcttatcaatacagccgtttttccaagccatataatgcgtttgctcgtcgccaagaatctcttcaaacgcctcggctgagataaacgtcgacccgtccagctgatagcactcgtccaaaggatagatttctcggttcgcgtattgttcctgagccttggacacaagcttgtcatccaatgcgctcatctgctgatcaacttcatcctgtgagggaatgaaaggggcgaagtccagccctgcttcgccacagcctctctgccgttcacgcctgtacatcacgtccgcacacgtatcggtctgccgttcattcaccattgatcagcctttcttttcgttccacaaatgccctagaacactgcgattccagtagttccgattgaatcaggatcgttcttgcgaaactgtcgaggatcgtggatcgcttgtggatcttgaagcgttgtatcctggttgttcatggatccggaacgcaaaatcattaacgtcgtgggagccgcaatcgtcaccaacggcaccgtactatgtgcacaacgcggtccggggaagtcgttggccggatactgggaattccccggcggcaaaatcgaacctcatgaaacagcgcggcaggctttacaccgcgaaatcgaagaagagctgttatgcgaagttgaagtcgcggaagaagtatgcaccagcgaatacgcctacgactttgggaccgtacggctcactacattcgtctgtcacctcatcgccggcacaccgcatctcaccgagcatactgatatccgatggctgaatcctgccgatatgccgacattgaactgggctccggtagatcgcgaagcagtcgcgattatcgccagcaaacagctgacgctccgatgaatgcgccatagcgcagccatgcagtcatgcagtcatcaacaaacaattcgaatcgcaagggaacaagacaacatgtctatcaatctggccagcacctcaagctctccggccaacacgcaacatagtggtcctggcccgacaccctcaatcctcgaagatgtcatctcaggtctgatcgagccgcgctcagatgctcccggcgaatataagccgaccctcatcgcaaatcgccccggtggattgaccatgcgcgaggaaatcggcaattccttggctactagcgattccttcgacatttctgtcgcattcgtctcggctgaggccgtgctcagcttatttgaagacttcagaagtcaccatgaaacagcgacccgagcgggcacactgattacctcaacgaaaaatcatttcaacgatcccagggcattctgggagctgctgcatcttcagaacaccactggtgttgacgttcgcgtgtgggaaggctcccgcaatgcctcagtggccgcaatggctcaaggacagccattccatccaaagggatatatcttttctcgccgcatgaaagacggtacgccctattacgacctgtacgttggcagttccaatctcactggagccgcattgaccacgcaacgcgaatggaatctcaaagtctcatcgctggcggatggagagctggtcgggcagttccaggatgaaatcgactcacaggtggccgattccgttccgctgaccgaagagtggatcaaacagtatgaggaagatttcaagaaatacgccccaccgcgtcatgagattctgcagtcgtttgaggggcatgacattcagccaaacgccatgcaacaggaggcgttggcgaatctcaagaaacttcgtgaacaaggcgagcaccgcgcaattatcgtgtcggccaccggcaccggaaagacgtacctttccgcattcgacgtacgcgaatgccagccgaagcgcatgctgtacatcgcccaacagcagatgattcttcaaaccgcaatgaactcttaccaaaaggtgctcggctgtgatgaatccgaattgggattgtattcaggcaccagcaagcaacaggaccgccgctacgtattcgccacggtacagacgatgcggcagccggaggttttggcgcaattcaaatccgatgaattcgactacgttctggttgacgaagttcatcacgctggagccgaaggatatcagcgcgtcatcaatcatttcaaagatgccgacttcatgctcggcatgaccgccacgccagagcgcaccgacggcatcaacatcttcgagctattcgggcataacatcgcgtacgaaattcgcttgcaaaaggcgttggacgagaacatgctctgtccattccactactacggcgttgcggaataccttggctccgacgacgatccgaatggaatcgcccatcgtctcgatgtctccaagggtcttgatgcgaaggactcgaaacagctcaagtacgagatcgagcagcttgccaccgaaaagcgagtccgctacatcattgacaagttgcaggaatatgggcagttcaacattccggtcaccggactcgtgttctgcagccgacaggaggaagcccataagctgtcccagctgtttaaccagcagtggaatcaacaagatgaacgcccctatcgcaccgctgccgttaccagcacggacgatgacggcaggcccgtgtcccaagcgcagcgagacgaatacgtccgcaagctcactgaaggcgaactcgactatctcttcactgtcgatatgttcaatgagggagtcgatattcccgccgtcaaccaaatcgtcatgttgcgcagcaccgaatccagcattatcttcacgcagcagctcgggcgcggactgcgcaaattccctcacaaagaaagcgttgtggttatcgatttcatcggcaattacaacaacaactatctgattccggtggcgttatacggcaacactggcgaccgcgacagggctcgcaagaacctgcagcgaaagtcaatcggcctgtcgtccatcagtttcgacccgatcgccaaggagcgcatccttaagtctttggacaccgccgactggtccgacatgaaaaagctgtccgaacagtatcgccaagtccgttacgagctgggccgcatccccatgcttacggacatctataactacgacccctcactgccgtataccatcgcatcgaagcgcagcaactatcttgatttcgtgcgttcccgtgaaaaaagcctgggcaaaggcaaacatcatgaagcgacatttgaggatcagttggagccggtgaccgacgttgaagacgcgatactcaagatggcagcggagctgctgctgcccggattgcgaccgcacgaattggtcattcttgctcagctatgccatttcgtcagcgaacggctcgacgacgacgtacctcagcattggagtgcgggctcgtcaatcggccgcagcgaactgctcgatgcgattcgtactgaattcccgctggccgatggttcagacgcgcaattcgactctgcgatcagcgtgctcgattattcatatttcaccggcccgaactgcaatcgttttggcaaccagccattggtcgaaaccttgaacagcaccggcacaggaagcgacaccgcatatcggttgagcagcagattcgccgacatacttgccacgaaccgaacgttccgcatcttcttcgcggacactttgcgcaccggtatggccaattgccgagatatgttccgcgaggccgccgccaggcaacaggtcttcgaccacatgttcttgtacgagcgcaaatattccatggctgacgtcatgcgcctgtgcggatggaagaaggaaaacactccgcaaaacgtgggtggttacctgctcgacaaggaaaccaacaccatgcccatcttcgtgaaatacgcggccagccaatacgaggatgaattcctgagcacacaggaaatgaaatacttcagcaagaacggacgcactccgcagtctccggaattccgatgggcgcttagcggcattggcccgaattgggaccacacacatttcgtcccgctattcgtcatgcgcaaggcggaagaggccgatggcaagtactactacgttggccacgtcgctgcgtttgagaatcctcagctcaccaccaagcctgacgcaaccggacagggcagtgtgaaggtcaccctgtcggtcctgcgtttggcccggccaatcgatccagagctctatcggcatttagccggctgaccatcagctcctcaaccgtacggcggcggccattccgccgtcgccgtaggtggggtgggccatgaaggcttgactggcggtggcgtcgccgcgcatcgactcgtcgtagccgccacagcgctcccacgcggcacggcgaattatgacgtggccgggcagcaattatgcgacacgaacgtggcggcgatgccacggttacgcgcggcgcatcatgcgatgctcgccggcgaccgtgtgctcatcctcacgcttggcgggcttgcgagcgcccgcaatattctccatgctcatgcctgctcatccccatccacaaccgaaatccagtcgccgtatccttcctcggccatgcgcgagcgcggcacgaagcgcagggcggcggaattcatgcagtagcgcaggccgccgcggtcggccgggccgtcggtgaacacgtggcccaagtgaatctgtgtgtccgacgtgcgcacttcgatgcggtcgcggcccggaatgcggtggtcctcatgctcggtcagcaagtcaccggcaatcgggcgagagaacgcgggccagccgcagccggaatcgaacttgtctcgcgacgagaacagcggctcgccgctgacgatgtccacgtaaatgccgggctcaaactcctcgtcatactcgttgacgaacgggcgctcggtagcggcgttctgtgtgaccgcgaactgctcaagcgtcagatcccagatgcgttccacgtacttctgacggcgttttacgttcgcgattgcggcgatcggcacatggcagtagccgccgggattgttcaccagatagtcctgatgatgtgcctcggccgggtagaagttgcgcagcggttcgaccagtacggccgggcgctgcggctggcggtcgaccagctgctccaaggccgccacatacacggcgcgctgcgtctcgtccgtgtagaacatgccagtgcggtactgccggccgcggtcttcgccctgctggtccacggagaacgggtcaatgacctccagaaacagtaatgtcagcgtccgcaggctgacctgtgccgggttaaactcgactttcacggtttcggccgcatccgtgccgcccgcgcatacctgctcgtaggtcggcgattcgacggtggattgcgcgtagccgaccgtggtgtccgtgacgccgtcgacgttctggaagtagcgctccagtccccagaagcagccgccggcgaagtatgcggtttgcgtatttccgtcattgtgttcgttacgttcgctcatgcgccccacgttactacgtcgaggcggctcgcgatgcagtcaacgacacctctgcaccggcaaaaccgctttcgaggggctgattcggccttcgcaggaggtctactcccgtttcaaggggctggtcggcagctagaccgcatgtaaaagcccatccgcgtcaacgccattccgccgattttggagcgtgaatactcggccatcagcccctcgaagcaggagtagacctcccggagaggccaaatcaacccctcgaaacggagatagcgccttctgcgcccttctcgctgggctttcgccgctcaaagaggtacattcgggcttctgcagaatgctttctccgttcaaagaggtaccgaatacgggaaatcccgagtacaaacgccgtcattgcaacgctcatactcgggatttcagagttcaggtacctctttgaaggcagttagctgtccgcaagaggccaaatgtacctcctgaaagcagatagccccatcttgggctcgaatcggtcagtctccgtgtccgtacgtgaacgaacaggcaaacggcctagagcctcaaccgcgagcacaattgtcagggtccgccccgcaccctacgaccgcagcgtgctgagcatgccggctacttcggcgggcgtcacgctgggcacgtaggcgcgcaccaccgcgagcccgatctgcggcaacgccgccgggtccgggtagcacacgtagaccggcgcttcggcgggctggaacttgcgcttgaagttgaacagcgagtggaagccgtaggcgggttccatccagtcggccacgatctgcagcgcgtgttggagcacctgcgtgccttcgccggccgccaccccaccttcccgggcattgtctcgctcggggttcatgccggccaagggtgccgcggacaggctcatgaactccacggcatgctcaggatccgcaagcccctcgtcgcgcaggcgctcggccatgcgcgcgatcaggaactccataatgccgttgggactgtcggtgcgatggcgcatgaagtccagcgtccagccgacgatgcgcccgtcgcgccaggtgggcagccagctggtgacgcccagcacgcgcccgtccgcgtcgatggcgtaaagcagccgcacgcgcgggtcgcgcagttcctcgacaccgccgagcgtgaacttcatttccggcagcgccttgagctgcgcccactcctcggagatgtcctcgatctgctcgcgcacatcgagcgacgcttccaggaacgtggactgcacatcggtcacgccgtcgcgcttggccttgttgatggcggtgcgcacatcctgccatttcttgccggtcgtcttccagccgcgcgggtccacgaccatttcgctgccgacctcgatggagctccagccggcctccagcaacgcgtcgcgctgttcgcgatgcacgctgtagaacaccggcgaaagcgaccgctccacgcaatactgggtgaagccggtcaggtcgtccatccactcggagggctcgccgaacggcccggtgcaggtcaaggcgatgccgttgagcacgcgatatgccacggccgatttgcccgtgggcgagagccagtagctgttgccttcccacgtagtcatgaagctcatcgattcgccgccggtttcgaccagccgctcggcgcgtgcctgcgcccgctcgttcgattcgctcacgtcgctcatccagcggatcaccacgaccagcaccacgatccagaacaccaggccgacgccctgatacacgatcgaggccatcggggtacgcggcacgaacgacaacttcatatggctcaggaagccgatgggcaggaagcgccccggcagttcggccaacagcgacgaggccgtggcacgcggcgagaattcatccggctgggcgatgccgtacatcaggtacacggcggcgcacgccagcagaaccagcacgatggcgccgacgccgccgatcagtcgccgccagccgacgcgaatcgggaaatgcttcaacgccgcagtcaaggcgacggcaaagaacagcggcggcaaggcgttcgccacgcaggcggtgatcgcgccgtgctgcagcagtgaggtcatgccgtccggcgcaaagctcagcggcacgatcaggtagtaggcgatggctactcccgcagtgaacaggttgatggccacggcacacatggccgcgaaccgacggccgcgatacaggccccacgccagcaccagggtcacggcggtgggcagcagcgaacgcagtaccgcgcccggcatcgaggctcgcaataggtcgaattgcaggaagcagccgctgtgcgtggcgccggccaggcagcgcgcgagcgtgccgtcgtcaacggagaccggactcatgagcaggccgaccgtgctgagcggccccgcgtgattatgcgaggtgatggcgatgatcggccccagcgccagcaccacggcgatggccgcaaacatgcgccgcgcctcgaaggaggtgctgcgcagccagtgccagccggtctcggcatgcgcgggcggcccggccatcacgcggccggccgcgtgtccgatcagcgcggcggcgagaatgcagtaatcgccaggattgccgctgtaaagcagcgcgaccagaatcgccacgtagccgatcagccgaatacgccgccgcaacagatggctgcagaacgcgctggccgccataagcgcgccgaccggcaacaccagcgggctcagggcgaactgcatgcgggagacgaattgggagtcctggaacagccatccggccgccgcacacaaggtcaggcccacgatcacgccgccgagcgcgcaggcgagcgcggtgccgacggtacgtgcgcggccaagccacggctcggcgattgacagcatgacgagccacagcgcggcatcaagaatgagctggatgacgccgcgcgccaagaacagcgtgcagaagagtttgccgaaatcgaattcggccatgctggtgtcgagccgcagcgggaacgcgaatccggccatcgcgaccaccagccacaccaccaagttcagcaccaccagcgccaccgtggcagtgatggccagtcgatgaccgtccgcccactgtcgcacgtcgccggccagttcgcgccagctttccgccgcatgactgttgtgcttacgcgattcttcgctcattgcaacacctccacttgtgggtactccttcaacgatttcgtcatctcgcccaagccggtccgttcgccaaaccagtcgagaccgggccgccagaccgcctgcaccgcgtgccagtcgtggccggcgccgggcacgatcagctcggtgacctccatgccggctttgcgcgcggcggcggcaatcgtgcgcatgttgctaatcgattccttgtcccgttcgccagcaccggtgaacagcgcctgctcgggcgtaccggtggcggcgatggcgttgaccggcacctgttcgtcgtacgccttgcggtcgccggcgaaatactcctggaccatcttggcgacgctgccattggtcggcttgagttcgccgtccaccggcaacatcgcgccgtagatttcgggatgacgcgggacgagctgcgtggtgcaggtgccgccttgcgagaacccacccatcgcccacatgcgggccgacttggccacgggcagcatcttcttggcccagttcaccacgtctgtggtgaggtaggtttcggcgttgccttgcgtggtgtcggcgcacaggctgttgtgcgtggcctcgccgttctggtcgggcacgagcacgatcggcgcgagcccgtcatgtttggcggcgtacgcattcatcgtggcggcgatgttgccggcgtcgatgaggcgactggggctaccgggctgcccggccaacagctccatcactggcaaggccggcggacggtcggacagcgcggcgggcggcaggtagatcatcgccttgcgggccgtgaagttggatttggcgttcggaatgtcgacggtgagcaccttgccttggctgggcatggacggcaggctgcccttctgcgccttgctacgccagtcgctgacgctcatcgcggccttgtgtacctcgattgagccgagcgaggcgtacggcgtgtagccgacgagggtgccgatggtctggtattcgccgtaaatcgagtccacgccgagcgcggtggacagcagcaccagcggcaccagcacgatggccagcacacggcgggctccgcgcatggtcacggctgcggcgatcacgaagccgacgccggcgatgccgcccgcgatggtgaagatcaccggccagcccagcgatacgccaaacaccataaacacgtcggacaccagccatgcaaccagcattccagccgcgccggcgagcacggcggcaatcagcgagacaatcagcgggtgcaggcggccgcgcttattgctcttgctcagcgccagtccaataaccagtatgattgccgcgatcgcggtcagtccgaacacggtccgtggcacgattccgcggaccagagacaattccatgaacgttttccaaacggagttcttcatccttcaccccccgcgctccaggctcctcgccttgtaagctcacgcaacactagcgcgcgattcatagagcgtcacccaatttcacaaaaattgtcgcgagttctcatggtttccccagactccgttcagcacctgttcacatccggtctggacgtccgcagctcaaggccagtgtcggcgctggattagcggcgcgcaggcttgtccccgatgtctatttagaagtgcaacacccttgttggtcctgtaattctaacagttattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcacacaaaaacccaaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgccatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtcggtttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcaccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggttagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattgggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatatcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcgcgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcgtcttcgcatgattcgggaacgattgtgacggcttctaccggcagttcacagattgccgaagcctgttcgccatagacggcacgaccggtatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtgggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagcgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgccggggataacgcgcggcaggaacaggcaaacctgtgcgaaggaacgaccgaccttggacttcatgtctttgatgagcacggcaatgatcaggccgagcacaatcgggatgatggagaagaagatgatcaggtagaaggagtgcagaatcgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttgggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccaggcatgccacagacatcagaccggcaataacggttttggcggttcgttcgatcctcattgatcattcctttcttccttccgggcgatcccggctatgtcttccttggctatctcggcttagcgtatttgctaagcgcttatgcatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttgactctcctcaaatcaagcgtcgctagcgaaagcggcatataagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcgtatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacggagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcgatcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgtgaacggctggccggctggttcatgggcgaattattcgacgggctgtatgacgaactgagccgcgcacgctatgacttgaccgtataccgagccggcagcgtcgaggagcgtgcggaattctttactcggctgccagccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcagtccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgactcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaacccgacggcgatcgcgcacatcacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgaaggggcttgcatgtctgatgtcaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatggcgaggtggtgtccggccggcacgaggtgccgatcggggcggatcagtcggctgagtatgtggtgtcggccatcacgcggctggtgcgcgaatgttccgccgatatcgcctcttccggactaccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcaatcgccgaacagtactctgcgattgtgggtcgcgcggtcagttttgaggactttgcgcgcgatgccaaggaacgcgtgccgcaggccacgcagttggtgaaccggacgtgtttccggttgggatcgctggtggctacggtggcgaatatcgcgatgcccgggcatgtgatgattgccggggagtccgcgtttttggccaagctcggcaccgattcgctacgtgacggcattcgtttctaccgtcacagccagacccagccggtcaagttcacgattatgaaccacgactggcagctctgggccaaagccgccgccagtcgcgtgattgtgaagcatattgggtaggccgttcttggctcccctcagagaggggagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacgggggacgaatgccgtagcgctgcagggcttcgccggtcaggactacgccttcctcgttccaccagccgagagtgctctggccgttggtcagaccggtcaaatccaagctcgggtcaagcgggctgacacggtaggtgcgctcggggtcaagtccgggcagatgcacgggcgcggccggataggtctggctggtggtcagctgggtgaagcggtagatggcggcgtcacggttcggcatcaccataccgtccagacgcacggccggatcgttggagtcggcgtgcacacaggtgtcgatggcgaaccagtcgcggtgcttcttgaattcggccacccacacggccagcttggcgagcgcctcgtccggctccttcaacaggttccattcgatgcccatgtggccgaagaacgccatggccatgcgcagttcctggctggtggcgcgctgggtggagtgtgcggggctggcgcccacgtgctcgcccatcatcgccggcggcaccagcagcgaggtgtagcgctggatatccgcgcgctcgaccgggtccacgcagtcggagacccagatacggtcggcgtgctctaggatgccgagatccacgcggccgccaccagaggagcagctttcgatctcaaggcccggatgcgcggtcttgaggcccttgaagatgttgtagacggcaagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccagcggtgggcgagagaatccaatcagggtggttgcgggccacatcggaatcggggttgaccatttccggctcgaaccacaagccgaattccatacccttggcgtgcacgtagtcggcgagcgccttcagggacttcgggccatcgggccagacgtcctgcgcaatctgccagtcaccgaggccggaggtgtcgtcgcggcgggaaccgaaccagccgtcgtccaccacgaatcgttccacgccggagtcggcggccttgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccagggccagcgagcgtcacttcgccgccgaacaggagttcgccgccgccgatcacgccggttgtgtagggcagacgttcggcggacagcacggagttgccgctccagcccacgtgcaccgaataggcgtcgccatgctcgaagccgaaaccgggcacgccggcggtcaggagcagggatgcgtcgaagtcagggcggccggcgagctgcggcttttcgaaacggccgacggtcagtggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccattcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggcctcgatattggtcacggtgaacttggggaagagctcgacgccggcgcggcgcagcaccacgcgctgctcgccgatccagctttcggcctgggtgggcaggatagacggccaggcggtgtcgtcgagcgcgccggacacgcgctgcggcttcagggcgtcataggcggccagcagggtgtcgggcttggccagcgggcggccccagtggacgatgtgcggcaggtcgctgccggcaaacaccagaccgatcgccacattggcggcgggctgggtcaggtagacggcggtgagtgcggtaccgtcagcggcggcaccggtgaaagtcgaggtgttctcggccatattgtctccttcgacgtgtgtggattggcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgccttccaacacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaggcgcccaaggcttgggccgcctgacgcatggcgatgatttcggcgtgggcaagcgggtcaccatcagcctcacgcgtgttgtatccgcgcccgacaatctggccggccgcatccagcaccaccgcaccaaccggtacgtcaccagcggctgcagcctgaccggccagttccagtgcgcggcgcatcgcctcgtcatattccataccaacgagtgtatgcctttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgccagtcgcttcgtaccgaaggtttccacaccgctggtccagattgtgctgggcgtgctggttacgtatctgccgtttttcccggatgcaacgctcgacccggaactgttcatggtgctgtttatcgcgccgctgctgtatctggaagcgcacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctaggtaaagaagcctcgctgacacagcgtcagcgcagcgtgctgaaaggcgaatcactcttcaatgacgcttccggcatcgtcggcttccagttcgctctggccgccgccttcactggcgaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgtaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggccccgaaccgtggcaaggatcccagcgcggaaataattccggtgaccatcgatgtgttacgcgccacggtggaggaattgaccggacgcatcacgccagagaatcgtcgtgcgattctgatggtaatcgaccagtacaccaagcgcatcgggcgattgcagcagcgcatcggcgataccgatccccagggattcgagcaattgcagatcgaagcgctgcattgggaaaaggaattcgtgcgcgaccggcttgccgacaccaaagcacatccggcggcggatacggccacgcaagagctgaacgtcgaaacctgcgagcgcatgcttgaccagattatgaatacgttgcgtcacacttccactgatccgacttcggggcacgcggtatcgcagattcgcggtcgtgtacgcatgttccagcggcagatgagcaattacgccaaacgcacggtgtccaagattcgccacaccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaggtcgatgccgattccggcatctagtttccttggctcccttctctgaggggagccaagttggggattgctatttccgtatgattctcttcagtatgtgcagtagtgcttgcagtgctcacttcgctcatgggagaacagtctatgaccgcgccggccacaagcgccctcgatgtccgattgctgtgacggccgcgccaattccagtgatggcggctgactacagcacgccagaggtaatgtcgttgtcgagcagccactggcgcaaatcggcgaactcctcaagactcacattgtgatccagaccgtggtagctcttggttttcagccacgtatgctcttccaaccaagcggcggtggcgaacagttcgtatttcgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcgggattgatacgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcaggacatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcacattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgcacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccacgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccgtcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgcctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcgggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctggctgcggttgccgcacaagcaccacagccggcggcagccacgcagccagtagtatccgaaacaccaatcgccgctgcgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaccccaatcaggccgagcagcctgcggtagatgccgaggcaacacaagcgttccagcctgatcaggtcatggcaacacagcctttcgaagctcaggccatgccgaatgccgaaaccgcggccacacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacacccgcaagatcgtcagcattgccgtagcagtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccggcaatccggctgacaccgccaagtgcgattccaacctcaacgccactgagttgaagtctcacactaaagagctgcagaatgatgccagcgacatggctgacaagacggatgccatcaacaacgcgatcaaggccgttaatacttcaaaggcgacggccgataccaacacactgaaatcgaacctgagctcggctatttcgcaggcgcagggcacgctggataattccgcgggcagtgtggccgatgaaaacacccgcaccgtgctgcaaaacgccatcaccgaggccaatacggtgatgaacgggaccagtccgtccgaatccgacgtcaataatgcgatttctaaactgcagaaggccgagtccgacgtcaccgcctcgatgcaggccaagcagcaggcagatgccgccaagcaagctcaggaagaggctcagcagaaggctgaccaagaggcacagcagaagtctcaagacgagtccaacaatagcgacaacaataacggcggcgacaactccacctctactgacggcactgacggcagcaacaactgaggtctgcagcgttctcctgtttcccatggggcggtaactccccatggggcggttagcatattttcctttttcgcggaataatgccgttttcagcgaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaacagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacgcccacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcatcgttcacaccgtcgccggtcatggccacgatgttgccttggcgctgcaaggattcgacgatcttgagcttgtgctcgggggccacgcgcgcgtacacggacacttcggacgtggccttgtcgagcgcggcctcatcgggcagctggtcgagctggtcgccggtcagggccttgccatccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcaatggcttcggcctgatcggcgatgtcggacacctggcctgcagcgttgacgcttacaccgggcacatcagccaaagaaccggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcaatgatggacatgcgcttgcgttcagaggtgaacggaatctcgccaacgcgcgtgtatcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacgagcgtggcgacgacttcatcggccacaatctgggcctgctcggattcaggactgacgccgccggtcataaccatgcggccttccggcgcgtaaccggtgccagtgatctgcacttcgccggacggggtgaccacacgttccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacagccaacagcaaggaatcaatcacgtcatggacgtcgttgaagccttccagcacggcgagcgccaccagcaccacgacagcgatgacgcacaccgcaatgccgaggatcttggagacgtaatccatctccttctgcagcggagttttctcatcttcggtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcttcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgccatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggctaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatcagtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcgtagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcatcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtccatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcagggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacacttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaaccgacaccgaccacactacgttgtagacgccctgatacgtgccacgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgcagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcctctcaatgccggcgaattccgcatgggtaacactgcattcgtcttcatggcgcaccgcacttggcaccgatacagtaatccccaaatgccgcacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagcagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcggtcgactaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtatgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtccttaggccaggtggccaagggcttgtgccagggcagcgtgaacatctttgggttcgagctggcggcggtgattttcagtgcttgcggttcggctgaattggcgtgttcgtcttcggctttgacagacgtggccttcagcgcacgcggatccatctggggcaattcgttcaactccatgtgttcgattttacgtggtgcttgggaagtgcgcttcccagccacatattcggcgcgttattctcgcatacgaataaacaaaaagtcgggtaatcccccacatgaatgagatcagaagaaatcaagccatctttaattttgtatcgcaagcaccagcaaaaagcatcgataaggggctgcggacgttttcttggagaccgaacggaaagattttcgtatgtccggtcttgaggaacgagagcgtgcggtggagttgtatttcaccacgccgatgacgacggcccaggtggtggagcatctgggttatccgaccaggcagtgtctggagcgttggctggcgatggattcccggtatgctggccatatggccaaacccatcatcccactggagaccaggcgaagggcagtcgagctggtgctgggcggcatgcagcagaagcaggccgccaaacagctcggcgcgggcgtcggcgcggtgcatggctgggtcagggcgtaccgcaagggcggcatggccgcgttgcagcccaaaaacaggaactccgcgcagggcaataagcccgcggactcccgccgccggccatccgcagccgatgatgatgacgcggaggctttgcgccgcagggtcgaggaaccggagccggagaacgcgttgatgcgggaggtggtggaggctcgcagaaaaagaccccggcgccgacctgcggcgcctgtcgaacagggagaagaccctgttgatcgaccggttgaggccggcgtattcgcccggctcgatgacatgcctgcccggcatcgcgcccagcggccacctactgccaccacgcccggctcggcgttgacaagtacgccggactcgggacggaggtggccggggcgttcgccgattccaagggcaggtacgggtaccgcaggatcaaggcggtgctcaagaccggcgtatcggagaaggtggtccgcaggatcatggcggaggaagggctcgtggcgcacgtgcccaagcgacgcaggtatggttcctacgagggcgagacgacgccggctcccgccaatctcgtcgaccgggacttcacggccgagcgtccgaacgagaagtggctgacggacatcagcgagatcaaggccagggacgggaagggcgtgcctttcgccgccggtcgactgcttcgatggcaagatcgtcgcatacaccgccggcttcagccccaacgcggagctggccaaccggatgccggagaaagcggcctcgacgctgccggggaacgcgcgtcccctggtgcattccgaccgtggatgccactgccggtggcccggatggctcgggctcatggaacgcttcgggctgacgcgctccatgagcgcgaagggctgttcgccggacaacgcggccgcggagggattcttcggcaggatgaagaccgaggcggtctaccccgagaagtgggaggaacacacccgcaacgaggtgctcgccttggtcgatgagtacatacgctggtacaaccacgagcgcatcaaacagtcgcttggttggatgagcccggtacaataccgtcaaagccaaggaatggctgcgtgattatctccaagaaaatgtccgcagccccttatctatgctgcaggcaccatgcacacgatggacaaggaaacagcaataaccgaagcaaggcaacgcttcaaggcatggcgctgccgtccagattcctttctgttcctccgttaaacccgcaacggacgaacttcaatttcgagcccattgtttcccctcatagattcgcaatctccttttcgggaggttactgcatacaatcatacaattggggacaaaagaacaaaaaacgttcatttgcgggggccggttagcgtacgttttctaggcaaaaagaaaagccccgcagctatgcagggcttttccaacgaggtcataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaagcctcagcggcggagccatcggtgatgatgttgccgtagatgtagccatcggagcccagatcctcgacgttgacgaccttcagggagaaggcgttcgggtcgtcagccggggccagaccagcgtcctcaggacggaagccgaccacgatctggccgttgtcttcggcggtgagcttggcgacggcctcagccggcaggtccacggtgtcctcaccgatcttcgccttgccgttgaccaccgggtgggtgttcaggttcatcgacggggagccgatgaagccggcaacgaagacgttggccggacgatcgtacagctcagtcggggcgccgacctgctgcaggataccgagcttgatgacggcgatgcgatcgcccatcgtcagagcctcggtctgatcgtgggtcacgtacagggtggtgacacccagctggcgctgcagggcagcaatctgggtacgggtctggacacgaagcttggcgtccaagttggacagcggctcatccatgaggaagaccttcggctcacggacgattgcacggcccatggccacacgctgacgctgaccaccggacagagccttcggcttgcggtcgaggtactcggtcaggtcgaggatctcagcggccttctcgacgcgcttgcggatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccgatgaggatgcggcccttgttgacctcttccaggccggcgagcatacgaagggtcgtagacttaccacagccagaagggccgacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgtgcttccgccctcgccaccgacgtacaactttgctttcggaaactgcaagcttcagcgtttacttttttccggttcagtgaaggttctcttcgttgagccgagaactactatacacggaccgtggaccaaggcaagcccgttgtctaaatgaaagtgcaacacccgttagattggaaattgcctagaaaaccgccacggtcttcgtttcggtggcttctggtcacctgaccctccttgcggtaggttaggtgttgcaacgatcactagaacccgcccccccttgtttttttttgggggggggtactgctcaccggggaaatatgtatatgtgcatgctgttgcaatgtacattttgttgtcagttgacaacgtcttgattcagatgaattggcgggaaatggccatttgtcttatccaattgatttgaagaacgttgtcagttgacaacgttttgtacatggtgcggaacgacacatattcctatcctggtcaggatgccgacgaggtggagtgaaaaccaaaccatttcagaggatattgcaccgagacgttgtgggattgccgtgttgtcggtgatgttacagagatggcgtagtgttgcgcgaggggtgttgcgtgaggggtgttgcgtgaggggtgttgcgtgaggggtgttgcgtgagggatgttgcgtgtgatgttgcgtgtgatgttgcgtgtgatgttgcgttgggctgattgggaggaatagtgtgccggtagaatgccgtgatgcgtgcagagcaatcgtttgcggagcaatcgttgaagaatcgtgtgaactgatgcgatacgaatcataccgtctctgaattgtgggatatgacgaatcgtatcgtcatgggattgtgggatatgatgattgcggtttgatgaaatgaccgggaaatcggccgaggcaaggtgacttcgatgagtgaaactctcaatgatgagaacgcggcgggcaacgatgacgtatcagagcggcgcgctgtagagcatcgagcgttagaacagtgcgatgtcgtgcatcacggtgtggtatctggttgccctgttaattcgtgtgcggctgtgctgaatgaagtgatgtcgcagactggttggaatgcctatgagcttgcacagcgcactggtttggatcggtctgcaattggtcgcgtattgcgtgggcaaagaggtatgttgtttgatgttttggtcgaggggcttgagcgggctggttttggtcttcacctagaagccgtggccccctcgcaaacgattccggaagacgaattgcacatgttgttggcgcaactgcgtaggcctcctgatttcgatgcaatagaaagcggagcgacctggtctacgttgaagatgctctgcgtcaatctgattcatgctcggaatgttcaacatcaacgtatatcgttcgtccgagcggttgcacgggtgaacgatgcgtgctggattgcgtttctcgctggtttataccgttttctgcgttgggatatcaacccaaggaacagacgcttgacattggttcctccgtaccggtatggcttggatggatggtggtccccactgccgagcgcggcaattatgcacgtgcttcatcgatatgaagagccgttgcatgacatggactatacatatttgccgttaatcgattacgaactcaacgctatgcagcgcaagcaattcaaccaagctttcatggaatatggcatccttattccagcggacgatctttcccaatcctcatcaggtacgcaggcattgactctgtaagcgagtggtgcataagaaaatagtggcgtgcagccaagtgtcatgggatggatatgtaagcagggaatgacattgcgctggagttcgatgatggttgacgagttgctatccaggcatagagcggatggcgtatgctggggcgcatggttgaaatcaaagacatgcttggcgatcaccaaataattcgtgccgacggccgcaaggtcgacgaactgcgccctgtgcgcatcacccgccacttcaccgacgcccccgaaggctccgtgctcatcgaatgcggtaacacgcgcgtgatgtgcaccgccacttttactcccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgaaaatcagattcagcttgactgcgatgtgcttcaggccgatggtggtactcgcacggcttccgtaaccggtgcgtacgtggctttggtcgacgcagttaattgggcggagaagcaccgccatatcaagtccgccagccgcgtgcttaaggactatgtgtccgccgtatcggtgggcgtgatcaacggcactcctatgcttgacctgccatacattgaagacagtcaggccatgaccgacatgaacgtggccatgaccggttccggcaccttcatcgagattcagggcaccgcggaacaccgtccgttcaaccgtgccgaactcggcaccctgcttgacttggccgaaaagggcaacaaggaactgcaagccgcccagcgtgccgctctgtccctagactaagccagctcccctgacaaggggagccttcttaaaggagaacctcatgcaaatcgtcgtcgcaacccataacgaaggcaagcttgtggaaatccgccgcattctcgaagaggatcttggcgcggatgccgaaaacatcgaactggtgtccgctggcagccttcacctgccggatccggtggaaaccggcgtcaccttccaggagaacgcgctactcaaggcccgcgctgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcgaagatattccggatgacaagcgtaccgcgcgcttccgctgcgccgccgcgctggtggtcccggacaccgagaccggtgccgacgtgaccggtggagtggctgccgacggcatcaccgttcacaccacggctgccgctgggagccctgccccggtgcatgcccgatacgccatcaagtcggagacagtggagctcggcgacatgccgggtcgcatcatccgcgaggctcgtggcgaacacggtttcggttacgatccgctgtttgtcccggacgatcagcctgccggtcgcgtcagtactgagcctgaccatgaaggcgagccgctgaccagcgccgagatgactccggccgagaagaatgcgatttcccaccgaggcaaggcgctgaaagccttggtccccgccatcgaggccctgctgcactaagtcgtctaggctgtctagctgcactgagccgcgactaagccacagttgagtcgcggctcagcactcagccccccgaatcgggcgagtgtctagcaagcgcctatgacctagcaagggcgatacgaaagaaggacggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcactgcaagccggacattcatcatctttgggccattgttctttggaccgggccattgttctttggaccatcgtggcggcaatagtgcgaacgatgtgcacacctcatctgctcggccgccattcgtcgtgtgcacgctatgctagcatggtgagcctgattgactcggaggcaaagggaagcatgcgtgattttgtgctggtgaagttgacagacgaggagttcgatgatttctccgccaggcatccacaaggcaatttccaacaaacctcggcgatgggacgccttcgcgccgcgcaggggatcgacgtcgaatatttggccctcaaggagggcgagaagatcgtcgcggcggcactgttcgaaactcaccgctctcgattctctacatttgcggtcatccatgatggcccgatgtgcgactatcacgacaccgaagcattgaccttcttcatggatgcgctgaaacgccatgccaaggcaaagggtgcttcacagctggaaatcacccctgaatccccgtatcggcttcgcgacaccaatggagcttctttgccggatgaccagaatggcgctcccgacaataagctgatagaacagctcgaggcgatcggcttcactcatggcggtttcaccgtgggctacacggcggttccgcgttggcgctacctcaaggatctgaccggcatcaccgatgagaaaagtctgctgaagtcctatgacaagcgcacccagtggagcgtgaagcgtgcccaatcgatgggtgtgcacgtgcgtgagctgtcggacgacgagctgggggtattcgcacgaatcgagcagcaaaccgctgaacgccgtagcttcgaataccgtggcgaagcatatttccaccgtttcaaggaagcgttcggcagcaaagcgcattttatggttgccgagatccacatcgacgaatacgtagcggacatgacgtccaagcgtgaagcgctttcggccaaggtggcggcattgaccgccaaaaacgccgaacaccccaccaccaaaaccgaacgtcagctgggggaggagacccgcaatctggcggcagccgaaaagcgcctgaacgaggcggccgagttcgccaaagacggggatgtactgccggctgcggcatcactattcgtggagcatccgcgcgaggtcatctacctgttctccggtagcgtcgagcagtacaagcccttctacgcctccgcgctgattcagcatgacgcgatgctgcatttctgcgtggaacacgggctgtctcgctacaacttctacggcatcgacggcgtctttgatgatcccgatgacgaggggcgtggtgtactggagttcaagcagggcttcaacggatatgtcgaggaacttccgggcgagttcgtgctgccggtcaaaccggtcgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcggccaaggcccatcacgccatcagcgtatcctgctggccggccgcagtctaccgtctgcatgatctggacggcaagccgaccagcgacccggacaccacgatgatggacaacatggcccgcttcggttggaaacatggcggtttcaccgtgggctacgaatccgtggtgaaccgctggaacttcgtcaaggggcttgacggcattcataatgagaaggaactgctggcctcgttctccaagtaccgccgtaagaacatccgcatcgcccaggattccggtctgcgcgtgcgccgactggaacgcggcgaactgagcactttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcgcgcaacagcagccggaaggcacggccaagaagggtgcttccgacccggcaacgctggaaaagcgcatcgccaccgcagacaagaagattgcggcgctggaaaagaccatcggcgaagtcaatggcatcatcgcctcggacggcccggtcattccggtggaagccggcgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctacggcatttccggtattttcgacgccaacgatccttcctacggcgtctggcagttcaagactcgcttcggcggattcgtggaagagcttccgggcaagttcacgctgccggtggacggactgcgcttcggtgtatccgaagcagcacacaagctgctgcatcgctgacaaacagtggcgagcacggacacagaaataaggcacaggtgacgacgagatgagcgcgactgcgaatcgaacagatacgacgtatacgtttggcgtgattacgcccgaagagctcgaccggctttccgaagccacaagccagggcagcttccagcaatggtccgggcaggtccgtcttgccaagattcgtgggcatgaagccgaatgcgttggcgtgtgcgacgcatccggcaatctggtaaccggctgcgtgattctgtacctcaatggtcgtttcggtgcagatggctccgtatatttcggccccatcggcattagcgatgatccggctctgctgcgggccataaccgaggcgattcgcgaatcagcccgtcgccaccatgctgtttccgtagcatgctggcctaacgtcgcctaccgtctgtattcctcgaacgggcagcccgacggcgagccgaacgatgcactactggccggattcgccgatgccggctggacgcatggcggattccataccggttatgacgtggtctgccagtggatgtacgtcaaggatctcaccggcatcaccaacggcaaggaactgctggcgtcattcggcaaacgtgctcagtggagtgtcaagcgggcgcaatcgatgggtgtgcacgttcgcgaaatcggccccgacgagttcgacgtgttcgccgatatcgaacggcggaccggtgaacgccgtgggttcgcgacgcgtggcgcagactatttccgccagttcaagcaggcgtatggcgcagatgcgcatttcatgctcgcggaaatccacatcgccgaatatgtggcggatatgaccgccaagcgcgaggcgttgcaggccaaggtagctcgattgcaggcgaaatacgatgaacgtccgaccacgcgtatcgaacgtcagctgggggaggaatcacgcaatctcgcggccgccgacaagcgtctggctgaggtggagggatacgccaggaagggcgatgtgctgccggcagcggcttcaatgttcgtcagtcaccccaatgaggtggtctatcagtattccggttcgttggaggagtataagccgttctacgcctcggcgctgattcagtacgaagcaatgctgcatctgtgtgtggagaagggcgtgccccgctacaacttctacggcatttccggcgtgttcgacgatccggacgacgagggccgcggcgtgctggaattcaagcagggctttaacggctacgtcgagcagatggtaggcaaattcacgttgccggtggataagttccgcttcggcgtgagcaatctggcgcacaagctgctgcgccggtagcggctgcggtcgggggacgagcctatgtgggctgcgtctcgtctgaccgtgcacccgccgtgtgcctacttgcgcatttgctcacacgcccatcagcgcgtgagccacagccatcatccccagtgaaatcatcgcggtgattgccagcgagaagccggccagtttggcgttgccgagtactttgtcggtgaacagcgtggagaaaatggcgatcggagccaacgcgcagatcaccatcacggcgcgaatcgaagccgagaacggcagcaggaaccacgcgatcaacgcgaaggcgacgctgaacggtatacgccaagcgatgacggccatgacttccttcacgtcatgcttggattggggcaggtccatgagcatgcccaccatcagcatcgacaccagcgcgttggcgccgctcaatggctgggttatagaggcgatccaatcgggaatcttcacgttggcgacggtcaacacgatcatgagcagatacgtgtcgaacggcaccgagccgaagaagctcttgccgatggtgcgcagcaatgcgcggcgggcaagccgtttggcgtcgcgatccttgggcttttcgtacggtagggtgggagccgaaccggcgtgttgttcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccgggaaagaaaaacagccgagattgaagccggcaccgttgagcatcaggaaggcgcggtcggtcacattgcgcttgcgggtggccagaaagatgaatacgaccgggataaaagcaaacaggaatgcgaataccgaaataagcagcagcgagatgtcatgcggattggtggcgaacgagtatacgatggcaccgggcagcacgatgttgaattccgcggtttgcaacacacgataatccttctgcccgaacaggccgaaccgcttgaacagatagccggtgagaatgatcagcaacaggccaaccggcgtaagaatggcggacatacacttctctccttgactcacacaggctcatggcgcacaggctcagacccgcaatgctgtggcccattatatttgccgccttggcattgccatatgtagaggtgtccgcaagggcttgcagctgccgcgcgcatacacgaaaagcctcccggaagcgttggcaatccaatgcttccaagaggctcaagccggtgcgcgagatgggacttgaacccacacgtcaaagacacaggaacctaaatcctgcgcgtctaccaattccgccactcgcgcgtgcatatccgcgtttccacaggtgtgggagatatgcaaaaccctaggccggacagccattacagaccgaccagcctagggcatccgagccacttgtcagaatcgaactgacgacctgctcattacgagtgagccgctctaccgactgagctaaagtggcttggttcgcggaaggcatttcgccagccgcgcacaagaaattaagtataagacatccccacgaaaagtccaatcggcggattggcggttgtgtcgcgaccgctcagtcgaagatgacggttgtgccgcgccacgaactgttcgataatgcaaacgatggcaatccgacatcgctgactcattttgttctgttcatgtccgaatttgtgagtattctgtttggtgatacggagcgcatccgagccgtgtgcaagggcgctccagtcactgatgaaaggaatggaatcctatggccatcaatccgcccgttgacgccacccagacccctgagtgggctgctctgcagaagcactatgacgagcttcaggtcgaaggcgtgagcctcaagaagtggttcgccgaggacgccgagcgcgtcgagaagctgtccttcgacgccggcgacctgcacttcgatctgtccaagaacctgatcaagccggaaaccctccagctgttcgccaaccttgccaaggccgtcaagctcgatgagcgcaccaaggctatgtacaccggcgtgcacatcaacaacaccgaagaccgcgccgtgctgcacaccgcgctgcgccgcccggtcgaagacgagggcaagtacatcgttgacggtcaggacaccgtcaaggacgtgcgcgaggtgctcgaccgcatctacgccttcgccgacaaggtccgttccggcgagtggaccggtgtgaccggcaagaagatcgaaaccgtggtcaacatcggcatcggcggctccgacctgggccccgtcatggtgtacgaggccctcaagccgtacgccgacgcgggcatctccgcccgctacatctccaacatcgacccgaacgacctggccgagaagaccaagggcctcgacccggagaccaccctgttcatcatcgtctccaagaccttcaccaccctggagaccctgaccaacgcccgtgaagcccgcacctggctgctcgaagagctcaaggccaagggcgccatcgacggctccgacgagaagaacgccgaagccatcaagaagcacttcgtcgccgtctccaccaacctggaaaaggtcgccgaattcggcatcgacccgaacaacgcgttcggcttctggaactgggtcggcggccgttactccgtcgactccgccgtcggcacctccctggctgtggtcttcggcccggcccgtttcgaggagttcctgcacggcttccacgagatcgacgaatacttcgccaacaccccgttcgagaagaacgtggtcgtgctgctcggcatgctcaacgtgtggtaccgcaacttcttcaaggtcgcctcccacgccgtgctgccgtacgaccagtacctgcaccgcttcccggcctacctgcagcagctgaccatggagtccaacggcaagtccgtgcgttgggacggtacccccgtcacctccgagaccggcgagatcttctggggcgagcctggcaccaacggccagcacgccttctaccagctgattcaccagggcacccagctcattccggccgacttcatcgcgttcgtcaacaccccgaacccgaccaaggacggcgaccaggacgtgcacgagctgttcctgggcaactacttcgctcagaccaaggctctggcattcggcaagaccgctgacgaggttcgcgccgagggcactccggaagagatcgttccggcccgcgtgttctccggcaaccgcccgaccacctccatcttcggcgtggcactgaccccgttcgcgctcggcgagctcatcgccctgtacgagcatatcaccttcgtcgagggcaccgtgtggggtctggactcctacgatcagtggggcgtcgagctgggcaagcagctcgccaagcagatcaccccggccatctcccaggatgacgaggctctggccgctcaggacgcctccacccagagcctgatcaagttctaccgcgcaaatcgcgaattctgattcgctttgctcggtcagaattcgtgattcgcgcgaccgcggctgtgctgtctggtgggcagtctggcgactgcccacgtcgcgaattctgattcgcttttctagctcctctcaatactgaggggagctgtcagcgaagctgactgagagggagttatggaacgctccgtatgctccccctcaactatgactgttgccggcggcggaactactggaataatcaccgtccatcggactctcacctccttcaagccgtgcgctgaaacgccaaatcaataccatcgtcggtatccatgcgaccagcaggagggacggaaagtattcgaatccgccatccgtgctgcctcggccaaactgatgcgttaataacggagagagacgacgacacgccgatactgtccgcaataatccgtaaaatagtcgattgctgtgtcgagaagtgggccgccgcataagcccgcgtctccatgggtccagtccgaacggccgcaaggcctgacttttggcggatcggcaggcttcccaagggcaaactcgagggataacgagaacaggtcaacgcgcgcgatgcgcaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagatcagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactccgctaagtgagtcgattcgcgggtgcaatcgtgagcctgatgatgcaggcacgcgaataaaccgtgaaattcagcccggaaccgtttcggtttcgggctgttttcgtattttccacgtatgatggacgggcgccggcacccctcatatccggcagcatgaatcgcgaggagatggtatgcaggacgatcaggataacggcgaattcccggtttccgacaatccggagagcaaccagacctcgtatgatgacgaggccgatgcccgcgattcccgcacgttccaagtcgctgaccacggcatcgccctgtccccggttcccccggcaccggcgcgcccggcgcacgccgcttcttccgctggcgcgggtgcagccgctggcgcgaatgccgcggcagcatcatcgtcagatgatgaccacttcaccctacgcgactttttcctgtggtgcggggttcccgtgcttatcgtgctgctgattcgcattttcgccgtcggcttttacgagattccttcgcgctcgatgatggacaccatggtgcccggcgatcgcgtggtgaccagcaagctcacccccaagatcttcgatttgcagcgcggcgacgtcgtggtattcaaagatcccaacaactggttgaacgaggagcagagcagcgctcccggtggcgggtacctcatcaagcgactgatcggcctgcccggtgacgtggtcgaatgcaagggcgcgggccagccggtgaccatcaacggcgtggccatcaatgagacctcctacattcgccccggcgtggacccgagcgccttcccgttctcggtaaccgtgaccgagggccgcgtgttcgtcatgggcgacaatcgcgccaattccgccgactcccgctatcatcaggatgacggcgatcgcggcttggttcccatctccgatgtggtcggagtcggaatcgcgaaatactggccgcttgaccggcttggtgcgattgatgaccaccacgaagtcttcaaggacgtgcctgacgcttccggctcgaattcctgagtcttttttgaaccgtgtgagtctttgaactgattgagttccgggccgcctgaaccctgaaccatatgaatcctggaccgtctgaatcctaaccattgtgagacgatgggagccgcgcatgattaccccgacacttgacttggaacgcatccttgcggcccagggctatgaccttatcgctggattcgatgaagtcggccgcggcgcgctcgccggtccggtgatggtcgggtgcgccgccatttgggcccgtgatttggagccgttggatggcgatgatgccgtcgaactgtccgggcggacctacctcggcgtaccggacggcgtggccgactccaaaatgctcaccgaacataggcgcgaggcgattttcgacgaactgcgcgactggtgcgcggcctacgccgtaggccaggccagcaacgccgagatcgacgaatggggcatcacctacgcgcttggcgtggccgccctgcgcgcgctcagccaagtcgaacgcgaacttggcttacggcttggaggggaatcgacgataaaaaaggcttcgggggagtctgcgggggagattgtggaaggtcgtccgggaggctccgtaggggaatccattagaaattgcgggggaagcgttcgcgctctgcccaaagtcgccggaattctcgacgggccgagcgattacatcaccaaggcgctcaacacgttcgacgcgccggacgtgccgattccagccgacataacgaccaaagtcaaaggcgaccagcattgcgccaccgtcgccaccgcggcggtcatcgccaaagtgacccgagaccggctgatggtcgacctcgcgcaaagcaacccacgttacgccgcctacgaatgggctcataacaagggctatggttccgccgcacaccgtaccgccatcgccgaacacgggccgactccgctccatcgtgtctcatggcacctgacctgagccgcgtgcgacacgacagtgtgagcgctaacgcaaaactgttgtggacgcgctaaagtcagtattgattaaggtacaagactggccgtgcatggatgccggccgccagcggggaggttaggcaatatggtgaccagccgcaagccaagcaaacgtccgtccatgttcgaagtggccaagctcgccggagtcagccaccaaaccgtctcccgtgtgatcaatgactcgccggacgtttccgacgccacccgtgcgcgagtccaggccgccattgaccaactcggctaccgcccctccaactccgcgcgcgcactggcttcccgccgttcgcgcaccatagggctgatcgccggaggcctcaaattcttcggcccgatttcctccatctcctccatcgaatccatggcccgcgagcacggtctgttcatgagcgtgatgatggtccacgaggccttgtgcgcgcaggccgacttcgacaacctgtgcgacaccttcaacgagcagaacgtcgacgccttcatcttcctgactccgaccgacgtgatgttcgccgccgcctgccgtgcgcgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcgaggcgcggcgttgcccaccgcggtcgtcgccgcgaacgacaatcaggccgtcggcatcatgcgcgcgttgcatgagcatgggcttcggattccgcaagacatcagcgtggtcggattcgacgacatgtctggcgtggataacatgtacccaccgctgaccaccgtgcatcccgatttcgaggggctcggcgtggccgccatgcgcgagacgctgcgcttgctgggggagggcggcgagccgaccttcctgaccactcagcacggcatggggctgattcccgccgaggttcgtgctcgacggtccttgggaccggctcctcggcggtaaattggccctgttatcaaaccgttatgatgcgtgacacggcataagttgtgtcgaatgcgggttgtcggtacaatgttttttggaaattgtgagcgctaacaccctccccaaggaaggggataacaacgccggcgctccaaggcaaaggaaagatatggcagcaaccgacaacgcggccgagcaggtcgcccacatcgccgagaagattcgcgctggcaagaccacgctgggcatcgaattcggctccacccgcatcaaggccgtcctcatcgacgacaacttccagaccatcgcctccggcgactacagctgggcttcccatctggaagatggtctgtggagctacaccaccgaggagatctggggcggtttgcagtccgcttacgcctccatggccaacgacgtcgagaccgcctatggcgagaagctcacgcacgtcggccacatcggcttctccgccatgatgcacggttacctcgcattcgacgaggccggcgaactgctggtgccgttccgcacctggcagaacaccaacacctccgaagctcacaagaagctctccgagctgttccagtacaacatccccgagcgttggtccatcgctcacctgtaccaggccgtgctcaacaaggaagagcacgtctccaaggtggcttacttcaccacactcgccggttacgtgcactggaagctcaccggtaagaaggtcctcggcgtgggcgatgcctccggcatgttcccgattgacccgaccactcacacttacgaaaccgcattcattgagaagttcgacgctctgcctgaggtcgcagcccagccgtggaagctggagaacctgcttcctgagccgcttgtggccggcactccggctggcgagctgaccgaggaaggcgccaagctgctcgatccgtccggcgccctgaagcccggcatcgtgctcgccccgcctgagggcgacgccggtactggcatggtagccaccaactccgtgcgcgtacgcactggtaacgtctccgccggcacctccatcttcgccatggtggttctggagcacaagctcaaggccctccaccctgaggttgacttggtcaccaccccggccggcgatctggccggtatgagccacgccaacaacttcacctccgacctcaacgcttgggtcggcctgttcggccagttcgccaaggctatcggccagccggttgacgcaggtatgctgtacggcaccctgttccgcgcggccatcgccgacgacgtggacgccaactgcggcggcctgctgaactacccgttccgttccggcgaattcctggccggtctgcctgaaggtcgcccgctgttcgcccgcagccccgaagccaacatgaccctcggcaacttcatgcgcgcccagctgttctccgcgttctccccggtcaagatcggcatggacgtgatgaccaagcaggagcgcgtgcaggtcgactctctcgtgggccacggcggcatcttcgccactccgaaggtggctcagaagattctcgctgctgccttcaacaccccgatcaaggtcatgtccaccgccgccgaaggtggcgcctggggcatggccgtgctcgccaactacctgtggaacaccaacgaggatcacagcaacctcgctgacttccttgacggttgcgtgttcaaggacgcccagtccaccactgagaagccggtggcttccgatgtggttggtttcgaggacttcttcgcccgcttcaccaagggcctgcccatcgagcacgccgccatcgaaaccatcaacctcgaagataagtaagcctttctggcctccctctattgagggaggtccttgagattttgaaaaaacgtccatccatcacagtggaaaggaaaaccaataatggcaactttggctgattacggccccgaggttcgcgccgaggtcaagcaggttcgtgaggtcgtctccaacctgcaccagcagctgatcaagtggaacctggtcgtgtggaccgcgggcaacgtttcccagcgtctgcacaccgccgacctgttcgtcatcaagccctccggcctgcgctacgagtacctgaccccgtcctccatggtcgtgtgcgaccttgacggcaacgtggtcgacggcaccgaagccccgtcctcggacaccgcttcccacgcctacatctaccgcaacatgcccgacgtctacggtgtcgtgcacacccactccacctacgccaccgcttgggctgccactggtcagaacatcccgtgcggcctgacgatgatgggtgacgagttcggcggcccggtgccggtcggcccgttccgtctgatcggctccgaggcgatcggcaagggtgtcgtcgagaccctcaagaagtacccgaagtccccggccgtcctcatgcagaaccatggccccttcaccatcggcaaggatgctgaaggcgccgtcaaggccgctgccatgaccgaggaagtcgctcacaccatgtgggccgcccgtcagctcggtgacatcatcgagatcgaccaggccgacatcgataagctcaacgaccgctaccagaacgtctacggtcagcactgatttgatggagtgtccgccgcgttacggaaggcccgacgtaccttcgtacgccttcgccttccgcgccttgcggacacacgcatcaaatcagcgctgactccgccagcacggtggtgtcttggctcccctctctgaggggagctgtcagcgatagctgactgaggggagcctcggtcggcgaatgaaacttaaacaaacccccataaacaaagaagtaaaggaagtaaccctatggttatggaaaaccccttcgagggcaaggaaatctggttcggcgttggttcgcaggacctgtacggcgaagaagccctgcgccaggtcgccattcactccgctgaaatggtcgactacctgaacaacaccggcaagattccggccaagatcgtcctcaagcccaccctgaagtcctccgacggtgtcaaggagttcatggtcgaggcttccgccaacccgaacgtcatcggcgtcatcacctggtgccacaccttctccccggccaagatgtggattcgcggcctcgaagtgctgaccaagccgctgctgcagctggccacccagcaccacaaggaaatcccgtgggagaccatcgacatggacttcatgaacctgaaccaggccgcccacggcgaccgtgagttcggttacatcgtctcccgcctcggcatcaagcgcaaggttgtcgtcggccactacaccgatcccgaggtcgccgagaagctcggcacctgggcccgcgcctgcgccggctgggatgcctccaacaacatgaaggtcatgcgctggggcgacaacatgcgtaacgtcgccgtcaccgagggcgacaagaccgaggctgagcgcgtgttcggcgcctccatcaacacttgggccgtcaacgagctcgtcgctgcgtacgacgccgtcaaggacgaccaggtcaaggagatcatcgaggactacaaggccaagtacgacgtcgacccggctctgctggacgccaagtacgactccctgttcatcgccgccaaggaagaggccgcgatggtcaacatgatgcgcgccaacggctgcaccgccggcgtcgacaacttcgaggacctcggcgctctgccgcagctgccgggcgttggcccgcagcgcttcccgtccgagtacggctggggcttctccgctgaaggcgactggaagaccgccgtcctcgtgcgcatcggtgccgtcatgggctacggccttgagggtggcgcctccctcatggaggactactcctacaacttcaccgagggtgacgagctcgacatgggctcccacatgctcgaggtttccccgtccatcggcaccatcgccaagccgaagctggagatccacccgctgggcatcggcggcaaggccgacccggtccgcctggtcttctccggcaagcccgccaaggacgccgtcgtggtctccatgtccgacgttcgcgaacgcttccgcctgctcatggacgtcgtcgacgtcgttgagccgcagggctccctcaaggagcttccgtgcgcccgcgccgtctgggagccgaagccgagcctgaagaccgctgttgagtgctggatcaccgccggtggttctcaccacacctgcatgaccacctccgttggtcgtgaggcttgggaagacttcgcccgcatcgccggtgttgagctcgccgtcatcgacgagaacaccaccgctcgccagttcgagaaggaactggagctgtccgagatgtaccaccgtctcaacaaccagcactgattggcggagcgtataccgcctttcctcaggttcgacgtaccttcgtacgccttcgccttcggacggcggtctccgcacgcgccaatcagcgctggcaagccagcactgatgactaaatcaatctgctgactgctaccgctgaaaaagggctgttccgggaaaccggggcagccccttttgctgttatcggcaactccccacaaacgcatcaaaaatcgcctgcgagcgtggatctaccttgtagagaaactcgggatgccactgcacggcccacaggaagtggcttgccggccggtacagggcctcgatcacgccgtcgggcgcaacggccatgatttcgagaccagcagcaggctcacgaaccgcctgatggtgatagctattcaccgcaatctcagtctgccctgcgaacaatgaagccaggggagtgccgggcaccaaggaaacgttatgtccgaacgcatcgtacggcggattcatatggtgttcgatatcgctcggatgctggcttggcagatcctgccacaacgtgccgcgcagcgctgcgttgatgaactgaatgccacggcagatgcccagaatcggcttgtcccaagccattacagctggcagcagaatcgattccattcggtcgcgctcaggagagagcacctcgctacggccggtggcggaggccgctgcaccaaccatcggtcccacatccggcccgcccgtaaacagaaacgcgtcaaaccgttcggcgcattgcgcaagaatgtcggtgtcatcggtcagcggcaacatgacgggcgtaccgccggcccgcattatcgcctccatatatccgggcagcatccacagactatcgcgcccgtaatccatcagcggagtcaccgcaatgagcggtcgattcgtagtcatgcctgcctcttttcgcccaagtgttgttttcgtcgttctgccgcaaatcgcttgattcagtggccaataatgccgccactgtaccgaaccaatgtaaccggtcggccaacattatttcgtcagccagccgcgacgagatcgcacaatgtgccaatgatggggggcattcggtgcgaccttgtcaatgttcgggccattgcactttcagcggggaaagcatgccccgtccgcgcatcatgatgaacgagtaaggttgacggggagggagaatcacatgaaccaggcatgcgtacgcaacgacaccatcgacgcgggcaaccatcatggccgaccgcaataccggtcgttcctgcgatttctgacatcgcaggaacgcaacgtcatttggctgttgctggccattgcttttcttccggtggacggcaccacgcttggcctgtacgcgccgttctggtcgccaatcagtccggcgctgttcgccgtgtactgcctatgcaattggcggcaactgcgcatcgcagccaaccggtacctgccaatgttcctcctaccggtggcctgcataatcctgtccatcccgggatggctgaagttcggcatccacctcaacgccgcgttcatgagcatcaccggattgctgggcgtgctcgccactttgggggcgatcgcccttgcattcgacatcaaacgcattccgtggcgtacgccattgcggattctcatcgcatcatactgggtttccttcggagtgggcgtcgtgcaatggctgtccatccgtctgcacgccaaaccgttgaccgactatttctcgcacctcatgtaccggcaatacatcagcgacaactcggtgtggggcggcggccgtccgcagttcctgttcgccgagcccagctatatcggcatgcacctgttcggcatactgcttccgctcatgtggctcatgcgcgggcgcgaccgcatctacgccaaacggctgcgtgacctcatcgtcacgtatgccgtcggcgcggtgctcatgcaagccggcaccagaatcgtcatcgattccgtcgtggcgttgctgatcgcccttgtggcgcgcaccgattggcatgacggcgcacgccgcgtccggggcatactgcagattctcggcgcatgcgcactgggcctgctgggtgtgctggcggattccagactctccgccatcgcggaaaacggggccgagggagacggctcgttcttcgcgcggatctaccaaagcctcgatccgatatgcggattgctcacccatccgtggacgctgctcaccggttatggcgcgggcaacatcatcaatgcggtgtgggccggcgcggccaaagccggacggctgctggacggtcttggcatgaacggcggcgcggccacgggattcgcggccggcgtgaacgcggacacggtgtggacgatgtgcgcgtataccagcgtcatcgccgaatacgggctgatcgggctggccatgctggtcggagcctcgatggtctgcatgacgcgcgggaggacggtatgccgtggcggtgcggatggcgcatcgtccgacgagctggcgcacggtgtttgtgtcgccgacgttgccgacgttgctgatgttgccgggggtaatagtggtggtggcgttgccggcgcgggttcgggcgaatccggcgtctggcacaagaccgtcatctgctggctcgtcctggtcgcatacctgtacatccaatgcgagaactatgcgttcgccgctctgccgcttcttgtgttcgctgcctcgaaggtgaggcgcgagcctgatttctcgcgggccgacgcatcgacgcggcccgagatggaccaaaatccagaataaccgacattcgccgctgttccgtttttcgctcaaggcgtatatctcccgtatcttgaggtgcatcatgtatcgtcgcggctaactaatcggcgaaacgcggcatgtttcgcattttgggcgaaaagcccaagtcccacaggaggtattgatgacgttcgttgcacggtcggtgcgctatgtgctcagaaaacgagtgcgaaccatagtgctccttataatactgaccatcataacggcgagcatgctatccacgatcgcggtttctcgggcagctcaacaggccgccggacgaatcgagaaggaagcggtcggtggattcgtgctgtccagcaacatgcagggcagcatgctcacgcctcgcggaggcggcatggtgcgccccgccgacgtgcgcaggatcgcccaactgcccggggtcgattcgtatatggtccgtcagaacgccaccgccgatctcgtgggggcgaatgtggcgaaggtccccggcggcgatgattacgatgcgacccaggagcagcagtttggcaacgccgccaacgtcatgggcacgaatgattcgtcgaaactcaacgtgttcacgtcgcgcacgctcggcatggccgaaggacgacatctgaaggcctccgacaagtacacgtcgatgatccatgaggatctcgccaaagccaacgggctcaaagtcggagacacgctcacgctcaaggccaacgcctatgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgacctgtaccagtacaaggacggcaaggaaatataccaggacgccaccttcgtgctgtccaagggcgttgacgtggagaagaccatggatgccgcgaagaaactcccggtggattggaacaactatcagatcacgcgcaacgaccagtattcatcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaagagatgggcatactggtgtcccttggcgtcggcaagccctccctggtcgcccaatacctcaccgagatggtgctgatcggtctgccgtccctcgccctcggctggctgtgcgcgcagggaatggcccaatggctcggcgccacggcgctccattccgtgaacgcctccgcggcgaaggagctgagcagcatggggcaggtcggcggcgatcttgaatccagcatgtcggtgcgcaccctggattcgctcacggtgtcggtcgacgggaccgccatgctgtacgtggcgctcggattgttggcggtgatgctggtgtgcgtcgcggtggcgtgcatgccgatgctgcgcaaatcgccgcgagacctgtcggagattcgatgatgagcatgaatgtgtggaagcgtgccacgttggcgatcgtacgcaagccggtacgtagcggcatcatcggtctgctgatgctgatggtcttcacgagcctggtggcgcaggtcggagtctcgacggccctgcgtaccatgtccgacggcatcggcgcgggcatgggcatagggtttaccgtcagcgccggcgagaatcccattagcgccgaggaggcgagccggttctcgcgtatccccggtgtgacgaagaccgcctatgcgacgaagaccttggcgcaggtggatggcacgcgcccggtcatgccccggcagggcccccgattggactccgatctggccatgcaggtcagcgtgctgggcaccaccgattcctcattgtccgaggaattccagagcggcctgtaccgcctggagcagggccgccatatctcgggcgacggcgacaatgtgctggtccaccgcgacttcgcgatgcagaacggcctatcggtcggctcgacattccgtctccggcaggaggggcgcaacgccacggtgcgtgtggccgggatcttctccggcaacgtgcaggcccaaagccccctgccctcggacacttccgagaacctcatctattcgggtaggcgagtagcttccgctctgaccggaaacgaccggatcgacatgatccgatgcctgtcggataatccgcaggacctgtccgcggctattggacgggccaagaccatggccggcggcaagtacgacgtcaccgacgattcggcccggctctccggcgtcctgcaatccgtgcagacggtgcgtaatctggtgcgcatggtgctgctgtccgtctgcctcgcggacgtactggtgctggcgatggcgctggtcttctggattcgctcacgcatccatgagataggcacgcttctggccctcggcatcgacaagatgcggatcgtcgcacaactcgccatcgaaaccggactcatggcggcggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacgatgctcatcctgctgctcggatgcgcggtcatcgccgtggctcttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccgtgttctttcggatgtcagcgcggatttcgaatccgggaagatgtatgcgatcaccggcccgtccggcgccggcaagagcacgctgctgtcgctgctggccggcctggacgccccctcccggggagtggtccgcttcgaaggggaggacatcgccgcatcgggctatgcgaagcaccgccgggagcacgtgtccctggtgttccaggaccataacctgatcgactacctcacccccgaagagaacctgcggctggtcagcgccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcacgccgcccatcagctcggcaaatgcgtgatcgtggtgacgcattccaagcgcgtcgccaactccgccgatgtcgtgctgcgtctcaggagcaagaaactgacccgggcatgacccacctgggccgggcggcaccccggcgacgacccgcatggaatcatcgtcataatgacgcctgcgatccctggacatgagaaaccgcacctccgatcatcgaatctggattactccagtccaacaatcggggtgcggttcaaaaggccctttttttgtgtcggattacgaaccgcgcgtctcaccgcttgccgttgtagatctcgttgtcgatcacatcggcgaacacgcgattgacggccgggcgcaccactttcagcgacggtgtcaggcacttgttctcctgcgtgaactgcgtgtccagcacggcgaacttgcgtacggattcggcgcgcgagaccgtcgcattcgccttgtccacgtactgctgaatctcctcgcgcaccgcggcgttcgtggcgagccggtcgaccggcgtctccgtggacaggccgtgcgcgggcagccacaatgccagcgactccggatcgagcgtcaccaacgcgccgatgaacgggcgctggtcgcccaccaccacgcagtgctccacgatcgggcacttggcgatctcttcctccagcggaatgggggagacgttcttgccgccggcagtaataataatgtccttgatgcggccggtgatgacgatgtggccctcatcatcgatctcggccaagtcgccggtcctgagccagccgtcggcggtgaacgcctcggccgtcttctccggcagattgtggtagccgcggaacacgttcgggcccttgacctgcagttcgccttcgtcggaaatgcgaatcgaggagccgggcgcgggctggcctacggtgccgatcacattgtcggtcacgcgcgtggcggcgaacggggcggcggtttcggtcatgccataaccctgaatcatcggcagtccgatgccgttgtagaaatgcgccagatcgagcgacagtggtgcgccgccgcaggccacgtacttgatcttcgggcccagagcaccgcgcaccgtgcggtagacgagcgtttcgtacttggcgcgctcggcgatttcggcaaacgtgtgctgctcgccggcctgctccttgcggctccagacgcgcgcggcctcggcggccttgacaaacaggcggcccttccagccggcaccggccttgtgcgaggcggcgttgtataccttctcgaacacgcgcggcacgcccagcaggtaggtcggttcaaacgaacgcaggtccggcagcagggttttggtgtccggcagataaccgaccacgccgtcatcggaggcgatggaggcgtactggatgaatcgcgcgaagcagtgggccagcggcaggaagagcagcaggcgcggatggtcgtcaagcaccacttcatgcaacgcctgcgaggcggagatggtgatggacacgaagttcttgtgggtcagttcggcacccttcgggttgccggtggagcccgaagtgtagacgatggtggccaggtcgcccgtgcgcacggtggccacgcgctcgttcagttcctcgtccgaaacagccacgcccagaccttcgagcgcgcccagcgcgttgccctcgatcatgagaatctgcttcaaggcaggacagtggtccttgaccgagtcgagccggtcaaagcgctcgcggttgtcggcaaaggccagcttgaccgccgaatcgttcatgatgcgctgggcttgcggggcggagtcggtgtcgtagatcggcacgcttaccgcgcccactgcggccagtgcgaaatcgagaatgccccattcgagacgggtggaggaaaagatggtcaccgcgtcgcccttggcgatgccgagcgcgatcaggcccttggcggctgagaccacgcgctcgtggaattcgccggtggtgacgttctgccagcggccggggccgattttcttggcggcgattaccgtgtccgcgccggtgcgggccagtcgttcggtgagcagtgaatagatagtttggtcatcgcggatctcgatggattcgccgggcgtggtgtattcggtaagcatacggccgtttattccttacaaacatgatggcaagttgacaacccgagccattctgacgagttagattacgctggcgtaaggttgcgcgcgttgtgggcaatggagaagttgtctgtctggttttgtggattgtatacaacgccgtgtctaaccggtttgctctacggttatgaccgtgtccatttcgggagccatcgacttcctgcaggacaagtacgtgctgagcccggccctgcagggtccggtcatcagctccagcatcatcggcggcgtcggcattggggagtctgtggcttcttatttgggaacgaagctcagcgtgacagtcgtctcagctgaaggtctggcgtgtatgtgcgctttcgcctaaggtaaataggattgcgcagtgcacgccatcggtatgtgcaggtatgcgattggtggcacccgcgactgatgcatgacgagacctactgcagtaccacggcaaccaacaccgcaacaacacggcaaggggaagcgaaccatgttcgacaaacgactgttccaattggcaccaggtctcggcaagctcatagccggcaaagtggctctgatgtgggttgggctgcttgccaatatcggcttcatgctttcgctggtcatgctgctgcaaggactgctcgccgcagccgacccacacactttctcctgtaacgccgcctcggcctccgagtgccccgccaatctgttcggcgttccgggcaccaccgtcgccccgatggccggcgacctcatggtttacgtggccttggcgatcgtctgcatgctggttcgctacctggccaccacacacgccacacgcctcggcaccgaagccgccgaacgggtcaagctcgctttgcgttccaagctgtaccgcaaaatggtggccctcggcccgtcctacaggtcgcgcgtcaagacctcggatgtggtccagtccgccggcgaaggcgtcgagcagattcaaagcttcttcgaactgttcctgccgcagctcttctatgcgattcttgcgccgatcaccctgttcgccgtgattgcgccgatcaacatgccggccgccgtgaccatgctcgtctgcgcgccgctcattattattgtcaccggcatcgtatccatgaccgccgcccgcgccttcaaaaaatactggggccgatacaccgacatgggtgccgcattcctcgacaacctgcaaggcctcgaaaccctgaagaacttcgacgccgacgaccgtgccgccgccgaaatggacaagaaggccgaaggcttccgcgtcatgaccatgcgcgtgctgcagatccagctgcgctcgctgaccgccatggatatcgtggcctacggcggtgcggcggccggcattggtgtggctctatggcagtatgcgcataccgccgcggccgccgcaggagccagcgccgccggctggtcgccggtcatgctcgccgcccacctgcccggtgcgttcgcctacctggcctacggcctgcaatacctgatgccattcggagcgggcttcccgctcaccctcgccggactgttgctgatcgtgctgctgtccgccgaattcttcatccccatgcgccaactcggctcctacttccacgtggcgatgaacggcatgacctccaccaaacggatcttcgccctgctggacacccccgagcccgcccacggcactgccacgctgccggccaccgctggcaccgatgccgggactgatgccggtaccaaggccggggccaaggccgatggcggaatcaccgtcagcttcgaccacgtcggctattcctatgacagcgccgattccggtgccgccattcaacaaacgaattccgcgccggcacctgcgctcaccgacctcaccttcactgcctaccccggtcaactcaccgccatcgtcggcatctccggttccggcaaatccacggctgccgcgctgcttgccggtacgttgaccggataccaaggctcgcttacgctgaacggcgtcaaggtatccgacctgtccggagagacgctcgcccgaaccatcaccctgatcggtgccagtagccatctgtttgccggtactctgcgtgagaaccttctgatggctttgcccgatgacggccagaacggtgaagccgcgtccgacgccgtggattcccgtctctgggacacgctcgaacaggcccgtatcgccgacttcgtgcgttcgcagcaggacggccttgacatgacgattgagcccgacgccgccaacctgtccggtggccagcgccagcgcatcgccatcgcccgtgcgcttctgcacgattcgccggtgttcgtattcgacgaggccaccagcagtgtggatgtggaatccgaggaactgattctcgcgaccatccgcgaactggtgcaatcccgcggcaagacggtgatcatgatcacccatcgcatggccaacgccgagcacgccgaccaagtggtggtgctcgaacacggcaagtcggtggaaaccggcacgcatgccgaactcatggcggccggcggcgtgtacgccaagttgttcactactcaggcggatatcgagaactttggggctgaccaccctcagccagcttcgctgacagcttccgccagcgggagcggggcggctgtgggcgcagctccggctgcagctccggccgagatgagcacgttccaggtcatcaagcgactactcggggaggccaagccactggccgggcttatggtcgcggcttccacggccggcaccatcggccaccttgccgcaaccttcctgccggtgttcggcatcatcgccggattcgcgctcgccggcaaccccgtgtggggcatgagtgcggccggtgcaatcaccgccatgattgtttgcgcggtgttgcgcggcctgacgcgctacgttgagcaatatctgaaccacaacgtggccttccacctgctcgcgctcttccgctccaaggctttcgccgcccttcgccgcctcgctccggccaagctcgccggcaagggcaagggcgacctcatcgccatgctcaccaccgacgtggaactgctcgaaatcttcttcgcgcataccatcagccccgtggccatagccgtgaccaccaccatcgtctacgccatcgtggcggccacgctgagcccctggatggcgttggcgctgatcgtctcccatctgatcatcggcatcattgtgccgcgcttcttcgccaccggcgtgcgcaatctgggccccgccatccgtggcgcggccggcgaactcgacaacgtgatgctcgacgacatgcgcggtctcgacgagatcatccgattcggtcggggtgaagatcgtgcgcaggccatcgaagatcgcacgcgcgcgctatggcgtgaccatgccaaactcagccgtgtcaacggccggttcgccggtgtcggcggattgctggttgcattgcttacctcggcggctgccggcatcgccatcaatcttgccggcgtgaacctctacgatatcccggcgctggtcgccgccttcgcgctgctcgccagctcgttcgggccgacgctggcgctcgccgccctgcccgcgaacctcacccagaccttcgcctccgcccgtcgtctgttcggcctgatggacgaagcgccggccgtggtggaaactggcactgcgaactcggattatgagggcatgcgccttgaccgcgtcatcttcgcgtacccgggggaggagagcgaggcgattctcgccgacttctcgctcgatgtgccgcagcacggcatcctcggtatccaaggcccgtccggccggggcaagtccactatgctgaagctgctgatgcgctattgggatccgcagcgcggccaagtgacgctgtccggcacgccgctaccgcaaatcgatgtgcatgcccgccgccgtattcaggccatgatgagtcaggagacccacctgttcgacggcatgattcgcgataacctgcttatcgccttgcccgaggcagagattcgcgatgggggagcggccggtgttcttgacgcccgactccgcgaagccctcgccaaggcatccgtgctcgacctgatcgattccctgccggatgggctcgacacccaggtgggcgagctgggcgaccgactgtctgaaggcgaacgccagcgcatcggcttggcccgtgtattcctgcgcaatgccgacttggtgctcttcgacgagccgaccagtcgtctggatgccttgaatgaagccatcattctgcgttccattcatgagctgtccaagagcgagcagaatgcggataaggggcaagacgtggctgtggtgctggtctctcaccgtgaatccgccatgcgcgttgccgatgcggtgctgaatctgtaaagtcgcacagtcacaggccgcaatactctgcaatacaggatttccttatatatcagcctctgataagggtatccagagagtcgagggccgcgttgatggcctgagcctcgcggtcgtcatccgtctcggcgaaggaatgctctctgtaggaatcctcgtcggcactgggcaacaacactccgcgaggcatatcggcactgtgcgcgtgcccaatagaggccatatgtgccggctgcacggcatttgtctgcttgcggtttcgattcgcgtcattcgcggaatcaacggcatctgcggcatcaacgctatctgtatcatccgcaccactgcgcgtagtcggccgattcgccagcgtgaatggatcgtcgggcagtgaatcggccaaggccgcgactgctgcgctggccgctgcctcggccgccgcgccgtccagcatcgcaccatccgcagagtcagtcacggagccatccacagagccatccgcagggccgttcgcagagccgtccgtatactcaccgtcgtgccgtctactggatgacttaccaaccagaacagcgcccctcgtacgccgcataagcgacggcacgttctcatccgtcgtaacttccgagacggtcgctgccgtgtcttcttctgcagccatattcgccgctgccttggcggcttcctcggcagcgcgctgcgcctccagccgttctgcctcgacccttttggcggtctctatggcgaaaatcttctgctgtgccgcagcgcgagcccgctcagccgcatccataatgcccaatgcctgctgacgttcgttttcaatacgacgcagcgtggcttccgcgtggcggatattcgcatcagccgtgctcagcgcgtattttgcgtaggccaaatcggttttcggctgccatagatgctcgatttcctccagcgtgcgtcccattgtctccggcaccaacgccacgatgccgaacaggcaaatcagatccagaaccgcgaaaatcgcgaacgatatgccgccgcccaatccatcgatcatcatcggcgtgaattgtgcgatgatccagttggcgaacagcagacacatcacacacaatccggtggcgcgaccgcgcagatacgtggggaagagctcgggaatcacaatccagggaatcggtcccatcgaaaaggcgaacgatatggtgaacgccatgacgaatataagcgtcagcagcgaattgcccatgaaatacgagcccgaaatgcatagcgcgaacacgcacatcatgccggtgcctatttccataagacgtttacggccgaacgtgtcgatcaggtacatgcctaccacggtggccaccagctccatgccgcctacgctggcggccgcgaggaactgagtgtccccggcgaacccgagatccgagaacatcaccggcccatagtaggaaatggcgttcatgccgatgaactggttgaacacggcgagaaagatgccgatgacgagtgcccgtcgcaggcctggacggaacaaatcatggaattcgtgcgacatctcggtttccagtttgaccgaggcttggatatcatcggtgcgcaggcgtgcgcgttcggtgccgaggatgtgctcgagcaccgcgaaaccttcatcggttctgcctatctgaatgaggaatcgtgggctttccggtgccctccgcatagccagcaggaaggtggcggccggaatcgcgcctaatcccagcatccagcgccatccagtggcgatatcccagtcgtttgatccgtgggaggcgatgatgtagttgatgacgttggtcaggaagataccgcaaaccgcaagcagctgataagagaaggcgagcagaccacggatgttggccggagccgattcggtgatgtatgtgacggccagcgcggcggtcaggccgatgccgtagccgccggccacgcgcgccacgataagcgctatgggacctatcgtcagcgcactccatacagccgcaacgaggaagaacgcgccgccgataataaggatacgtttcctgccgaatcggtcggaaaggaatccggcggtggccgctccgatgacggcaccgagcatgatggaggaaacgacgaggccctccatgagagtactgagcccgtatctggcgcgcaggaattcgatggcaccggagatggagacggtgtcgtagccgtacagtaatccggcaagacccgcactcaaagccagtccgaatgtatattttcctgatccgcgggtgcgtatggctgttcctaaaggattgggctgcttggaagcagtccgaaacagtcccgccatgtgctcttcctctcaatacagctatggtggtgcctattcatactagccgaactggctccgtctggcgctggacatccacgaatgtgaacgctctcggaattgtggatgtcggaggctgaagattcttctgtgtgcccgaggtggcgagttttggcgggaaatcaggcgtgtcgcttgattttgacaaattggtacacgggtgtatcatcatagatattggtacacgggtgtaccaaagaaaacaccccaaaaaagaccgtcagcggagcatatcgcaggcgaggaacccaggcccaaggtaagtccaaagtcccgaagccacgaccaatcccaacggctcaggaggagataacatgcgcaacaccaagaaggtcatcgcagcaacggccgccgccagcaacatagcatcggccatgagccggtacaataaaggacttgattgatatgactactcgtagaacgttcaggtggccgtccctgctgactgaatccggtcgtggcatcgcgttcggcggcgactacaatccggaccagtggtccgaggagacgctggacgaggacatccgcctgatggtccaagccggcgtcaacaccgtggccctcgccatcttcagctgggacaagatcgaaccgcgcgagggcgagttcacgttcgagtggcttgaccacgtgatcgacaagctcggcgcggcgggcatcgccgtggacctggcatcggccactgccacggccccgttgtggctgtacgagcgtcatcctgaggtgctgccaatcgatcggtacggccatgtggtcaatgcgggctcacgccagtcgtggcagcccacaagcccggtgctcaaggaatacgcgctgtgcctgtgccgcaaacttgccgaacactacaaggacaatccatacgtgacggcctggcacatgggcaacgaatacggctggaacaaccgctacgactactccgacaacgccttggccgcgttccgcacgtggtgcgaggccaaatacgggaccgtcgacgcgttgaacgaagcgtggggcacggccttctggtcccagcacgtgaacagcttcgacgaggtgttgctgcctcgccacatgggcggcgacagcatggtcaacccgccccagcagttggattacgagcggttcggcaacgacatgctgctcgacttctacaaggccgaacgcgacgccatcgaagaaatctgccccggcaagccgttcaccacgaacttcatggtctccaccgaccaatgcaccatggactacgcgcaatgggcaaacgaagtggacttcgtgtccaacgatcactacttccatgagggcgaatcccatctggacgaactcgcctgctcggacgcgctcatggactcgctcgcgctcggcaagccgtggtacgtgatggagcactccacctccgccgtccaatggaagccgcttaacatgcgcaagcgcgccggcgagctcatgcgcgactccttggcccacgtggccatgggtgccgacgccatcaacttcttccaatggagacaatccgcatcgggtgccgaggcgttccactccgcgatggtgccccacgcgggctccgatacgaaactgtttcgaggagtgtgcgaactcggcgccgcgctgaagacgctgtccgacgcgggtgtgcaagacacggaactgaagcgcgcggacacggcgattctgtttagtgcggaatccgaatgggccactcgctccgagaccctgcccagcatgaaactcaatcactggcatgacgtacgcgactggtatcgcggatatctcgatgccggagcgcgcgcggacgtggtcccgctcgcctacgattggagcggctaccagactatcgtgctgcccaccgtgatcgccctgtccgacgaggatacccgtcgcatcgcggacttcgccgaaaacggcggtacggtcatcgtcggctatgccaccggcctgatcgacgaacacttccacatcggtttcggcggataccccggcgccggcaacgggctcctgcgcgacatgctcggcatccgctccgaagaattcaacatcctcggagaagaagccgaagacgaaccggccgaaatcggtttgtcgaatggactcacgacacgtctgtggcagaatgacgtgacctcggtcgctccagacactcgcgtgcttgccacgtacgtgggtacagccgctgctgactgggagctcgacggcgtccccgccatcaccagtcacccccacggccaaggcgccgccatctacgtgggctgcgatcttggccgccacgacatcacccacttgctcaaggaactcaacacaacagccccctccgacgaaagggctcccgaccaaaggccgggtgggggagagatcaacgccgcaactacgaccgcagcagccacgactcatgacccccgcatcctgcacaccatccgccaatcctcagacggtaccatccgcttcgatttctatctgaaccgttcgaagcagcccgttgccgtcaacggtgtggaaggtgatcccatcatcgcccaccgttgcgagactgacgccgttggatatacgctgaaccgcaacgccattcttatcgctaaaacgtcctgctaaaccgcgctagaatggcaatgttgtccggatagaggagtgtggcatgagcgacgagaaaacagccaagcgtcgagtgacgctacgcgatgtcgctcaggccgccggtgtatcgctcaaaactgcgtcgaacgtgatcaatggctccgggcgtatgaccgatgaaacccgtgcaaaggttgaaacagtcattaaggacctcggctaccgagtcaacgtggccgcccgtaacctcaaccgcgatcacaccggtttcatcacccttgccgtgccttcgctgattccgccatatttggccgagttggccaaccgcaccatcgaggccgcccgtcagcgcgactactccgtatacgtcaccacgtatgcagagggctcggccaaaggagcgcgtgacctgctcaagaacttcaactccaccgtgtcagacggcatgattctctccatgagcgaggtggaggatatttcgcccgaagacctgaaggtcgatttcccgctggttattgtcggtgcccgaaccacatggggtgttgccgaccacgtgactccggacgatgttgccgccgcagcaacagcggcaggctacctatacgatcgaggttcttctcgcctcgctgtagtgggcgcacgagacgactatgacgcggccgctttgttgcaggctgtggaaggcaacgcacaactgcgtttgcgtggtgtcattgaagaaacgcgccgccgtgggctctccttggatccgcagctgattggcaacaccggtcaggattggaccatcggagccggtgcccgtgtgatccagcggctcattgattccggcgtgccattcgacggtgtgatcgccctgaacgatcagttggccatcggcgcattgaccgctctgcgcaccgctggttatgaggtgcccgcgcaggtgcaggtcatcggcttcgacaacaacgaggaagccccctacctgcagattccgctgaccaccatggattcccgccttgactggacagctcccacggcagtgaatcgcatcctcggacgcatcgacggcagcatcaccaagcccgaactgctcaccaccgaatcccaagtcatcgcccgcgcctccacacgctgacgctaatctggctcccctccctgaggggagctgtcaccgaaggtgactgaggggagtcttgcggaacattgtcatctcccgtcgtaactcgtaattgtcactcgtttgaggggccccatgtgtcatcggaggtagctgttcactccgttccgagttcgtgcatctccccccccacgataagagacgccgtggcgggttctagtgatcgttgcaacacctgacctaccgcaaggagggtcaggtgaccagaagccaccgaaacgaagaccgtggcggagcggacaacgggactcgaacccgcggtctcaaccttggcaaggttgcgctttaccaactaagctatgtccgcgtgtgtttccttggcgaggtctccctgccgaagcacgagtgtttactatacacacatgcgtgtagttcgtccagctgcggcgtgtcgcctgtaattgcatactctcgcttatggctaaagcgtgcgcttcgggcaatgaactccagttactctagaggtatgagtgaagcagcgaaggacaccggcgcagtattgatcgccgcattcgagggatggaatgatgcctgtcaggcggcgacgaacgcggtgcgccatctggtcaagcgatatgagtcccgcgagattcgtcatattaaatgtgatgatttctatgactatcaggttgcccgtcctatgctgtgccatgtttcgggacgcaccaatcttatctggccgcagaccacgttctacgacatcacgttggacgcaggcaagcatatctatgcgcagatcgcccccgaaccaaactatcggtggaaggaatactgtagccagagtctggccattgccgatgagctggatgtcaatcggatcattacgttaggttcgatgttctccgattgcccgcatacccgtccgttgcccatcgccgtcagcgacggagactgtcaatgcgaaggagaccggtcgtataacggcccggtaggcattcctactgttctggatgtagctgccgcacaacaaggatttgctcattcctcgatgtgggtgtccatcccccaatatttgggcagcgacgaatgctctgccggcactatgcgattgctggatgcgttgggcaagcatatcggcttcaccttcgatacggcagatctgaagcagaaagccgaacagtggaaggcgcaggcatcgatactggttcgttgcaatgaccagcttcacgattacgtggagcatttggagcacgactacgacttgcagcagaaagccgaggcggaggcttccttgggagcgccccaggctgaacaactggtcaaagaagcggaagcgtttctacgccagatgggcaattagccctatacacacaatactcccgctgacgggagctggctcgcgtagcgagactgagggtggttctgctggcatattccagtgaccacccccagtcagcttcgctgacagctcccgccggcgggagcaccattattgagtcgcctatcgacccgtcttatgccgcagccaccacggagggatcgatggccggcagcacgcccacaatcagcagcaaggcgacgaccacagccaaaccgatgcggtagatggcgaaggccttataggagaagttcgatacgaacttcaggaatccgatgatcacgatgtagccgagtacgaagctgatgaccatggctacgagggtcggcccccagccggggaacatcgcatcggttttgtagttcttcacggccttgatggcttcgagcaaacctgagccgaacaccgcggggatggccatcaggaagctcagacgtacagcggcctcacgcgtgtagcccagtgcgcgaccgacggtgatggtgccgccggagcgggacacaccaggaatcagcgccatggactggcccaaaccgaagaggaacgcatcacgatacgtcatatcattcatggttttgttctggcgagccttggcatccaccatccacagcagaatgccgaataccaacagcacggttaccgtaatccacaggttgcgcaacgaggtctcgatgacgttctgcagagtgaagccgaggataataatcggaatcgagccgacgataatgttccagccgagtgtggcgtaattgtcgccgcggcccatgcgggccttccaatccttgccgttcttgccgaacaggcagctgaaccagtgagtaaggatattgatgatgtcgtgacggaaatacagaatcaccgcaagttcggtgccgatttggatgatggcggtaaacgccgcaccgggatcagagcccagcatcaaatcgccgaaaatacggatatgcgcgctggaggataccgggagatactcggtcagcgcctgaacgatgccgagaatgatcgcttggaaaaaattcataacccctcgtgatttctaagtatttgatgtgttatgacgatgaacaccctatccaagggggtgtagaacaacactaagaatcggtaacatccacggcttctacaatgaaagtggatatagtacgtaagcgacgaagggagcattatggccacgtatcgcaaaagcagggcattcgcgccggaaggattcttcgaatgcgagggtcgaggactcgaatggttgggagcggctcatgcgcaggacggcccgcgcgtggtgcaggtatacggctggggcaaggattatctggatatcgaacgtgtgggcagcgcgtcccccacgcctcaggcggcacgagcttttggtgcggctctggcccgtatgcatgatgcgggtgccaagtatttcgggtctgcgcctgacggatataacggcacatgctatttcggaccattgcaggacccggtgaaaatggataccggcgagtggaccgacccgatcagctatttcgctgatggacgtctgcgcccgatggtcaaccttggtgtgaaacgtggcgagctggataagcgcgatgtcgagttgactgagcgtgtgattgaagcgctgccggatctgatgggccgcgccgcggccgacaagccggcgcgcatccacggtgatctgtggagcggcaatgtgatgtggaccgccgattccgggcagtccgaggccgtgctcatcgacccggcggcacatggcggtcatcgcgaggaggatctggctatgctgcacctgttcggtatgagctatctgagcgaaatcaccgagggctaccagtccgtacatccattgaaggccggatggcaggagcgcatcacgctctggcagctctaccccatcgccggccactgcgtcttcttcggcggcggctacgtcaacgaataccgctccatgtgccgctccctgctgaagtaacagacttggctcccctcagagggggagccaagaacgcatccgctctcagctcagtgcgtccttcaacttgctgaagaaacctttcttttgaccggcctgtggacgggatgcctgggagacgtgcgtggcgcctgaatcgtgcgaggcggcgaactgttcgatgaggccacgctcggtttcgttgagcttggtggggataagcacattgacgtgggcgatgaggttgccgcgctcgtccttgttgcggatgttcgtgacgcccagtcccttaagcgtcaccgtgtcctcagtctggcagccggccgggatggacacggtcttctcaccatcgaacgtatcaatggacagatcgtggccaagcacggcccagctcatcggcacctgaatccagcagtgcaggtcgtcgccatcgcgggtgaactgcttatccgccttgatgcggatgtcgatgtacaggtcgccggcagcgccgccgccctcacccacttcgccctggttggccaaccgcagacgcgcgttgtcgttgatgccggcgggcacggtaacgcccacggtacgcgtggtgcgcacacggccgtggcccatgcagctggggcacgggttctggatgatggtaccgtggccctcgcaacgttcacagggggcggaggtcatcatctggccgagcatggtgcgcacgaccttctgcatgaatccctgtccgtggcagtcggggcaggtgaccggctgtgcgccgccctgggcaccggagccaccgcactcctggcacagggagaacgtattgatcttgacatgcgcggtgccgccgaacaccgccgtcttcaaatcgatggacgccgaggccaaggcatcgcggccgggctgggtacgcggcaccgggccctgtgagccaccgccgaacgcggaaccgaagaacgtggagaacacgtcgctcatatcgccgaagcccgccccggagaagccgccggcaccggcgttcgggttgttcgggtcgactcccgaatcatacatacggcgtttgtccggattggacagcacatcgtaggcgttgttcacttccttgaacttgtcctcgaactcagggcccgcgatgtcggggtggtacttacggctgagcttgcggtatgccttcttgatctcgtcgtcactggcgccgcgttccacacccagcgtctcgtaataatctgccacttgattgatcctttgtgttcgtttggtctgcgggtcattgtgccacagacggcggtcagtcttgagtccggccctcggagaggaaggcggtcaaatatctggctacggccctgacggcggccatagtggccgcgtagtccatgtgggtcggccctatggagccaacgaaggcgatgggttccgtgtctttcgtctggctctccgtctcggattcggtttcgggttcgcctacgggatcgttccccgccggttcgcccgccgctccgctgcgcccatagccactgctgaccacggaagcatgcagtagtccgggggtgtgcatttcggagccgatggccacgcccacgccggatgcattcgtctcctcgctcaggttgctcatgagcttcatcagcacgacctgttcttccagcgcgtcgaagagcggggccagatcggccagggaccgggagtgggccaggtgcgaggtgccggacatgtacagttcgttcgcgcgttcgtccaatgccatcgattcgaaggcgtcggccagcgcgtcggccacgccacgcaccgactcgtagccggcgctggcggcgatggatcgcacggtctccgcggatttcgatagggacagcccgtcgcattgctcgttgacggtgttggagagccggttgatctcgtccacggcgggcatggatgcgatggtcaggccgtgctgggccacgcggcctgtgtcggtaatcaccacggcgagcaacgtggtcatggcaacgggcaccatctccacgtgccgcaatgtggccttggccagcgatggcgaggcgactacggccacttgaccggtgatttcggacagcagtcgtgccgaacgttgcagcgcgtccttgagactcaccgatccggacaggaagctgttgatgccgcggcgttgcgcctcgctgagcggcaccacggtagcaagtcggtccacaaagtatcgatagcccttttcggtgggcacgcgaccggccgaagtgtgcggctgaatcagatagccttcgtcctccagagcggccatatcgttacggatggtggccgaactgacgccgagatcatggtcgcgcgtcagcgaagtggagcccacaggctcctgagaacggatgtaatcctccaccacggcgcgcagcaccagcatgcgtcttgattgcgtcatgcgcgcctcctcatatatgcatacatattcatatcagtcacggttcactcagggcgtaccccgacggtcggttcgccacgccgcgacacgcgggaacccagaaatattgcctctttcttggctccgccacgtgcaggtggcgcacttcaccttagaacattgtattagcactccttaggcttgagtgctaatgcgttcgtttgcagcgtagcaatgttcactgtgaacgctaacagaacacaaactaccaaaacacgccaaaattgcaccacaacgtcgcaaaccgacgctagcatggtaatcgcaatgtgagggcgtcaagcgcccggcacaagccggatacgcggcccgaccaattggaaggaaagtaatccatgaccgaattcaaggagaccgagctcgacgagcgcgccatcaagatggcgaaggtcctttcggctgacgcggttgagaaggcaggctccggccaccccggctcccccatctccctggcgcccgtcgcctacacgctgtaccagcacttcatcaagcacgatccgaatgatcccaactgggaaggccgagatcgcttcatcctttccggtggccacgcctccctcacccagtacgtccagctgtacttctccggctacggcgtgaccctggacgaccttaagaacttccgtggcggcgctgccacccgcaccccgggccacccggagtacggcctgaccccgggcatcgaaatgaccaccggccctctgggccagggcttcgcctccgccatcggctttgcctacggcgagcgtttccagcgcggtctgcttgacccggagaccccgaaggaagattccccgttctaccacaagatctgggccatctgcggtgagggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggtctggctgacgtcatcgccaaggccgagaaggccgctccggaccagccgaagctcatcaaggttcactccctgatcgcttggccgaccccgggcaagaccaacgacccgtcctcccacggttccaagctgggtaccgaggctgttgccggcctcaaggaagccctcggctacgatccggaagagaacttccacgttgacgaagaggctctggctcacgctcgcaaggttgccgagcgcggtctcgaagcccacaaggaatgggacgagaagttcgacgcttggcgcaaggccaacccggacaaggctgccctgtacgaccgtctgaaggccggtgaactgccggaaggcttcgacaaggctcttgacgaccttgaggccaccttcgaagtcggcaagggtgtcgccactcgtggcgcctccggctccgtgctcaacgccatcgccgctgtcatgccggaactctggggcggctccgccgacctcggtggctccaacaagaccgatctcaagggcgctgccaccttcgccccggccgagtgcgccaccaagcagtggccgaactgcaacgagttcggtcgccagctgcacttcggcgtgcgcgagttcaccatgggctgcatcaccaacggcatcctgctgggctcccacacccgtccgttcggcggcaccttcttcatgttctccgactacgagcgttccgccgttcgtctggccgccctcatggagattccgaacctgtacatctggtcccacgactccgtcgccgtcggcgaggatggcccgacccaccagccggttgagcaccttgcttccttccgcgcgattcctcagcttgaggtcattcgcccggccgacgccttcgagaccgccgaggcttaccgttacttcttcgagaagaagaacaccctgcctggtgccatggttctgacccgtcagggtgtcccggttcttgccgagaccgccgccaaggccaaggacggtgtcaagaagggcgcttacgttctggtcgacaccgagggcactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggccgtgcttccggccgctgtcaaggctcgtgtctccgtcgaggccggcgttgccatgccgtggtacaagtacctcggctcctacggcaagcccgtctccatcgagcagttcggcctgcagggcgacggcgctcagaacatgatcgacctcggcatcaccgccgagcacgtggtggaagccgccaaggcctccatcgccgaagtcgaagccgccaagtgagtcccctagcctccctctgacgagggaggcttgtactcaagactccacctgatcggccctctcgttagagggggtctacttaaagatttgttccaatacggaatataaggagaaaaataaatgactgaagcaactcagcgtacgtctgacaacggcgtttccatctggctggacgacctgtcccgctcccgcatcgagtccggctccctgcaggacctcatcgccaacaagaacgtcgtcggtgtgaccaccaacccgtccatcttccagaaggccctgagccaggtcggcccgtacgacgctcagctcaaggagctcggcaaggttgacgttgagaccgctgtccgcgagctcaccaccaccgacgtgcgcaacgccaccgacatcttccgcgagatcgctgaggctaccgacttcgtcgacggccgcgtctccatcgaggtcgacccgcgtctggcccacgacaccgagaacaccgccaagcaggctgtggaactctgggagaaggtcaaccgcccgaacgccatgatcaagattccggcaaccctcgaaggcctgccggccatcaccgccaccctggccaagggtatctccgtgaacgtcaccctgatcttctcactcgagcgctacgagcaggtcatcgacgcttacatcgagggcatcgctcaggctgccgccaacggccacgacctgaagcacatcggctccgtcgcttccttcttcgtgtcccgcgtggacaccgctgtcgacaagctgctggaagccaacggctccgacgaggccaaggctctggagggcaaggccgctgtggccaacgctcgcctggcttacgaactcttcgagaagaagttcgccgaggatccgcgttgggccgacctggctgccaagggcgccaaggttcagcgtccgctgtgggcttccaccggcaccaagaacgccgcctactccgactgcaagtacgttgacgagctcgttgccaagcacatcgtcaacaccatgccggagaagaccctgaacgctctggccgaccacggcaacggcgctccgtccatcgagggcacctacgaagagtcccacgccatcatcaacaagctggctgagctcggcatcaacctcaaggacgtcaccgacaagctggaggccgacggtgtcgctgccttcatcaagtcctgggattccgtgctgtctgacgtccagtccggcatcgaccgcgtgaacgcctgagatttgacgactgatgcgtgtttagcgcactagttgattagctcacagaagccccgaccccaacggtcggggcttctttcgtttgttgctacagtggtacgagcatatgagagaaaggccgaatcgtaatgaacaaacttgtcgcacgccagcggttggtgatgaccttcaccttcttttcgatgttcttcggagcgggcaatctgatttttccgccgttcgtcggcgcgcaggccggttccgcgaccataccggcggccatcggtttcatcgtctccgcagtcggcctgccgattctcggcgtgctggcggtcaccttcgccggcggtttcgacaaactcgccagccgggtctcccccaaattcgccttgttcctcggcgtggcgatcatgctcaccatcggcccgtgctttgcgattccgcgtacggcgaccacctcattcgaaatgatggtggctcctttcgtaccgtcctcctatggctggctggcccaactcatctactcgctcgtgttcttcacgctggcgttcctgtttgcccagcatcccgagaaactctccaaagtgctcggccgattcatgggaccgttgctgctggtgctcattgctgtcctgttcatcgcctgcctgatccacggcatcggcaccccggccaacccgatgggcgactactccacaaaccagatcgcacgcggcttcctcgacggctaccagaccatggacctgctcgccgcgctctacttcggcatcgtgatctctgcgaatatccgcgcccaacaagtcgatgacgaatcgcaagtgcagaaggagaccgcgtatgccgggctcggcaccggcgtactgctgatcgtgatttacggcgcgctaagctacgtgggcgtggtgtccggcgccatcgccaccatcgaccccaccaaagacacgggcgcgaccgtgctcaccaacctcacctcatccctgttcggcacgttcggtactgcgttccttggcatcgtgttcgtcatcgcctgcctcaacgtatgcaccggactgatcggcacctgcgccacctacttccatactcggttccggaccgtcgccggccgaacgttgagctaccgcacctggcaggtcatcttcaccgtgttcagtttcatcgtgtccaatgccgggctaagcgcgatcatcaaggtttccgtgccggtgttgtccgcactgtatccgatcgccatcgtgctggtactgctgacgctgacccacaagtcgctcggcgcgcgattcccgcgcgtctacttctggaccgtgctgctggtgggcatcgcatccttcgccacctgcatctccagtttggtcgccgtcttcggcggttccatcggctggctggacgcggcgctggctatgctgcctttgcagcaataccagctcggctgggtggtcccggctatcctcggtgttgccattggtatcgccgatgctccgcgacggtagttcttcccggtctgtgccggagtctggcggtcggtcggtgatggcggctgccgcagtatccctcctataaagcggcatacagaattcctgtatgccgctggtctccgcccatctgccatagttatactggcatcatcgacgacggcgataacggcataaggtggggtgagtcatggacaccagtgatagacagatagcggaaaccggccggaatcgcgagcttgggctgattccggccatggtgatggcggttgttgcgacgctcagtggtgccggtgtatcgttcgcgccattatatgagcgcatttggggcggcatgatgttgcatccgaattgtccggcgattggcagaatgacctactatctctcgggccaagcaactgacgattatggagcctgcgtcacctcaccactgtggtttatgacggtgactgcgctgagtgttgtcgcgattctctgtctgactgttgcgggagtacagggcttttcgcgccatcggctctgttcggtgtttagtgttcttattgcggcagtggctgttgcgatcatattggtgttgagtgcgaataccaagattgtaacgttgtgggcgatgtatgcggtgacgtggctggtgcacgccatagtcacctcatatctgagcaacggttggatacgaatcgcgcgactgttgttcgtatggcagattggcgtgatgccggtattcgtcaccgaatattcagtatccgacgaggtcaacttcagcggcggcgcaaccatcgcttgcggacttggacttgcggcatatgcgctggtgcaatgcgcctctcttaccatcgactcgcaaaacaacagtaatcgaatcacgccagaacgcagtggtatacgggctacctccttgcacgacctgttccacaccatcagcatcaacgcatccgccatacgcaattgctctgttcccgttgccctgttctggtcaggtatcacgttctttacctacagctacaacactggtagacacaccgatttctgcccagcgctatcggcaactgacaatgcaggtcttgtcgcttattgcatcggccatgaagctttgggactgctgaccgtcgtgttgtgcgtgctgccattgttctccctgctttcggcgattacggccatcacgttggctgcacgcaacgcaaataacggcggtaacgctgccaatgccgatggctctcgaaattcagccgccgtgtgctatctgctcctggcaaccgcactgtccgccacggccttcgtcatcgccttcaccttggcatagcgcggaccaccatgccgcggttcgcgcgatcgctgggatacagcgcttcctgcgcacgacgcgacaccaccggcataagatctccttcatatcacgaaacaatcgagcgtgttcgtttgcgccaaggatcagctctgccagtagtagctgaagaagtcggagatctcccccatggtttcgcgcagcatgcccatgcgcggcaggtacaccacgcggaagtggtcggggcgatgccagttgaacgcgccgccgtggctgatgaggatgtgcttgtcatgcagcaggtcgagcgcgaactgctcgtccgagtggatgttgaagcgtttgacgtcgatcttcgggaagatgtagaacgcggccttcggcttgacggcggtgatgccgggaatctggttgagcatgtcgtagacgaggtcgcgctggtcgtgcacgcggccgcccggcacgatgtagtcattgacgctctggtggccgccaagcgcggtctgcaccacggactgggcgggcacgttcgaacacatgcgcatgttggcgagcatgttgaggccctcgatgtagtccttggcaatgcgcttgttgccggacaggatcatccagccgatgcggtagccggcgatcatgtgcgatttcgacaggccggagaaggtcacgcagaacaggtccggggccatcgaggcgatggagatgtgctgcaggccgtccatgacgaggcgatcgtagatttcgtcggagaagatgatgagctggtgttcgcgcgcgatgtcgacgatctgctggagcacttcctttgggtaaagtgcgccggtggggttgttcgggttgatgatgacaatcgccttggtgttgctggtgatcttggagcggatgtcgtcgatgtccggataccattcggactgttcgtcgcacaggtagtgcacggcggtgccgccggccaggttcacgcaggcggtccacagcgggtagtccggggagggcacgagcacttcgtcgccggtgtcgagcagcgcggacatggacaggttgatgagctcgctgacgccgttgccggtgtagatgtcgtcgatggtgacgttcgggatgttcttcagctgcgcgtactgcatgatggccttgcgcgcggagaacaggcccttggacggcgagtagccttcggtgtcggtgagctggtgggccatgtcgtagacgacttcgtccggcgtgcggaagccgaagggtgccgggttgccgatgttcaatttcaggatgtgggtgccgttggcctccatgcgcatcgcctcgtcggcgaccgggccgcgcacgtcgtagagcacgttgtcgagcttgtgcgatttgccgaaggtgcggcggcggcccacgggaatctcgctgtccgtctggggcttggcggcacccatggcaagcggtgtggcggcgtgttcgccgtccgtgacgctgttggatgcgtccgagttcaattgcgtggtggattcctcgccgcgcagccaattcgtgtcgacgtccagttcgctggccaggaattcgagcacgtcctcgcggggcatggtcttgccggccacatattggctgatgtggctcttgcccatctttacgccacgatgttcggcggcgtgcaccaaatcgacctgcttcaatcccctgctgttcatcgcattgcgcagacgttccgcaaacaccgatacgctcatatccttatgcctccaaccgggagttcaatttatcttttgaacaacggttcaaagcatacccccggttcaacacaagttcaattttggcgtgttctcgagtctcgaccggttcaacccaactgcgcttcaatccattgggcgacgccgtcctcgttgttggacgggcagatctcgtcggcgacggacaacaccttggggttcgcgttggccacggccacgccccggccggattcgctcatcatgttgatatcgatgaggtcgtcgccgaaggcggctgtctgttcaagcggcacgtccagtcgctcgcacagcaggtgcagcgcgtgctccttgttggcctgcgggttcatgagcatccacatcacgccttcgctgatggagatgtcgaagtccggcggaatcagcgcacgcagctcgttccactgttcaggttcggggaagatggtgattttgtccgccacgccttcgggcacgtcgtggaagttcgtgtattggaaggcctgagttttccaatacacgcgcacatcgaagttggtgtagcgcacgtcgttcatcacgatgccgagcttcaggccgggcatgcgatcgagcaggaacagacagacttcgcaggcacgccgtgaggagaagccaatcttgatcaaatggttctcatcggccggcgtggcacctgaggtgagcaggtcgaagtcggagtgggccgggtcgaaatcgatgagggcgccgttcagatagattacggcgtccaccggcagtttttcggcgaactggagaccggtactcaccggccgcgcggtggcgatggcgaattgcattccggcatcgtgcgcgcggttgatggtgtcgatgctgcgctgggtaatgaaccggtcctcgaatacctcggcgtcgtgcagcaacgtgccgtcgaggtcggcgaccagcagtcggggttgtttcggcgtgatggcgtcgagaatcacagcagcccctcacagtgttcacgcacgagttcggcggaatggtgcagtttggcccgctcgtcctcgctcagatcgagttcgacgatctcgttggcaccattggcgcgcagttcagtggggacgccgaggaacacgtcatgttcgccgtattcgccgtccagcagggtggagacgggcacgatgcggcgttcgtcccacaggatggtctgtacgatgccggccacggtggaggcgatgccgaagttggtgccgcccttggccgcgacgatctcattgccacgggtgcgggtcttctcttcgatttcggtggtggacacggaggcgaaacggtcttggttgtcggccaggaagcgggcgaatggcttgccgccgagcgagacggtggaccatgcggtgaactgggagtcgccgtgctcgcccatcacgaagccgcccacgttgcgcgggtcaaggccggtctcttcgccgatgatggtcttgagacgcgaggtgtcgagcgcggtgccggtaccgagcacctgggtgcgaggcagaccggaacgtttccaggcataccaagccatcacgtcgaccgggttggagaccatgacgatcacgccgtcaaaaccggaggccatgacgttgtcgaccacttcgcccacaagacccacggtgaagccgagttcggccatgcggttggagttggccggcggcttgcggcccacggtgatgacgacgatgtccgcatccttgcagtcggcgtagtcgccggcgcgcaccttgacgtggcggtcctggaattcgctgccatcatcgaggtcgcgggcctcccccagggccttggcggcggaacagtcgatgagcacaagctcattgcacaggccgtgcgtgacgatgccgaaggcggcggtggcaccgacccggccggtgccgacgataacgactttgttgcggttcatagtgaccatggtgatgtcctttcgtaatactcgatagaacgcatacgacccatgaccgacggtaacggtcatgggtcgcgagcgacaagtctatatggcgtgcaagccgatcagccgaggttgaacttggtcatcatgtcgaggccgatgatcaaggctacccacaccagagcgatgataacggtccaacggttcaggttcttttcggcgacaccggaagtaccggcgttctgggtcagaccgccgccgaacatgtcggacaaaccgccgcccttgcccttgtgcataaggatgagcagggtcagcacgaagctgagcagcacgacgatgacttgcagcgtgatcttaagagcggtcacagggtacctccggattgattggactgttgaccagcatagcgcacacacgggaaaaccgtggtattagttccgtgatttcgtggatttcagtgccagtcgagcgattttggcgagttcctcaacgtccagggccgcccctccgatcaggaagccgtcaacgtcgggctgggaaatgagttccgccgcgtttttcgaggtgaccgatccgccgtacaggatacgtacgctatcggataccttcgtgccaaaagtggtcttcaaatcgttgcggatggcgtttgcggcatcctgggcggattgcggagtggccaccatgccggtgccaatggcccagacgggttcgtaggccacgatgagtttggcggcttgttcttcgttgagatcgcgggtgacgtctcgtacctggcccacggcgaaatcgagttcaatgccttgacgtcgttcctcgaagctttcgccgacgcacaaaatcggctgcatgccggcggcgagcacggcacgtacctgatcgacgatattggcgtcatcttcaggatggtatttgcggcgttcggagtggccgacgatgacgtatgagcagccaagatgggcgatcatgtccgcggacacatcgccggtgaaggcaccttgggtggtcacggaaacggattgtgcgccgtaggcgacatggagcttgtcggcttcgaccagcacctgcacgctgcgcaatgacgtgaacgaggggaaaagcgcgacttcgcagcgtttaaagtcgaagtgagcgtcacgcaacagccataccagcttctgcacgaagtaagtggcttcaagatggtcgaaattcatcttccagttgccggccaccaacggaatgcgtttggacgccatatgtttcccttctaaaaaaaacgtagctcccctcaaggaggggagctagaaaatggattactcaagcaccttcaggccagggagctccttgccttcgaggaactcgagggaagcgccaccaccggtggagatgtgggagaagccgtcctccgggaagccgaggttgcgcacggcggaggcggagtcgccgccaccgacgatggtgaacgcaccggctgcggtggcgtcgaccagaccctgggccacggccttggtgccggcggcgaactcaggaacctcgaacacgcccatcgggccgttccacacgacggtcttggagtcgacgatcttgtcgtggaagagcttctgggactccgggccgatgtccagacccatcttgtcggccgggatggcgtcggcggcaacgacttccggagcaaccggggtgtcaccggccgggaagccggcgttcacgacgacgtcggtcggcagcacgagctcaacgccgttcttctcggcggtctcgatgtagcccttgaccttctcaagctggtcctcttcaagcagggaggtgccgacctcgtagcccttggccttgaggaaggtgaacaccatgccaccgccgatgaccagacggttggccttgtcgagcaggttctcgatgacgccgagcttgtcggagaccttggaaccgccgagcaccacggtgaacggacgctccgggttctcggtggccttggacaaggccttgacttccttctcgaccagcaggcctgcggcggccggcagatcggcggcaacgtcgtagttggagccctgagcgcggtggaccacgccgaagccatcggaaacgaaggcctcgccgagggcggcgatcttcttggcgtaagcggcgcgttcgtcggcgtccttagaggtctcctccgggttgaaacgaacgttctcaagcagcacaacgtcgccatcgttcatggcggcgaccttggcctgagcgtcctcgccgtaggtgtccttggccagcggcacgttggcgccgagcagctcgccgaggcgggcggcaaccggggccaggctcagctcaggaacgaccttgcccttcgggcggccaaggtgggccatgaggatgaccttggcgccttcttcgcgcagggtcttgatggtcggcagagcagccttgattcgaccgtcatcggtgatggtggtgccgtccagcggaacattgaaatcagcgcgaaccagaacgcgcttgcccttgagatctccaaggtccttgagtgtcttcatgaatatcctttccttgacgaatcgcacgtcaaagtggccaattttgccactttgcatattacaggcattccggaacaaaacaccgcattcgtctactgactgaatgcggtgttttgtcacatcgttgtcgcgttttgccgaataggcacggcaaatcggattgtcgggttacttgccttcggctgcgcgagccttctccgtcttctcggcaagttgaagcagtcggcgaattcggccggcaatcgcatccttggtgatttgcggttcggcgatcttgccgagctcctcgaggctcttgtccacgtgatcgatgcgcagctggccggcctgacggaggttgtccggaatgttatcgccgagtacttcgaaagcatgctgcactttttcgctggcttcggcggcggccttggcggaacggcgcatattggcgtcatcgaagttggccagacggttggccttgccgcgggcctcgccatcggaacgcttgccggtccattcgcgagccgaacgggtggcgcccatgagcttgagcatgcgttcgatggcgtcgggatccttgagtgtcacgcgctcggagctacgcagcgtgcgatgcttggcctggatgcctagacgacgggccacgccacacagggccatggcggcctcttccgtggggcaagcgatttccaggaagctggccttaccgggatcggacaggaagccacgggccatgaaggcgccgcgccatgccgctttgatttgggcgatggatccgttgaccacttcagacggcagtccacggacctgctgcttgcggcggtcgaccagtccggtctgcaaagccaaggccactacgttgcgggtgacgagcaccacgtaggtctcgacagggccgttcggggtctgacgtgtgaggtgattgacctcggcttcgtgcccgaacgtgttcctcaacgtgttcttcagccattctgcaacgtcaagcgaggtgaatacggcttggataacgtatgtattctgtaccggtcgaagaccgccgccaaaacggatcatggccgcagcttgggccttgatcgcggctggcgaatcgccttcaaaggctgccaactcgcttttgacatcgtccagaagagccaagatctacctcctacagtcccgttcttctcaatgcttcaggcgcttcgtgccgttatctgctgtcacacggtcggaagccatcggctttctgtgatacctaatctggtggacaagcgaacccgtttgatacgtattatgggctctgctttctcgcagtgtggtcaccgaacgcttgcccgatgaccgctcgacgcctgcttacgatgagtgacgcttgtgctgttctctcgcggaaacggttacgttgagcccatgtgcgcgtaagcggcgagccagctcttcgctcatcgccaccgaccggtgctgaccaccggtgcagccgacggcgatggttacgtagtgcttgtcttcctgggcgtatccttccaacgcaatctcgatagctttctcataagcgtcgagaaattccttggctcccttgctggaaagcacgtagtcggcgaccggcttgtcgtgcccggtaagctcgcgcaggctgggcacccagaacgggttgggcagaaaacgcacgtcggccacgaaatcggcgtcgatgggcataccgtatttgaagccgaagctgaagatgtgtactgccacggtggtggggccggagccgagcatcgcctcgtagagtttggtggacagctggtggatgctcagggagctggtgtcgatgacccagtcggctcgttccttgaggtcttccagcaggtgacgttcctcaaggatgccgtcgatcagtcggttgccgtgctgcagcgggtgcgggcggcgcacggattcatagcgcttgatgagcacttcgttgctggcgtcgaggaacagaatacgggttttgacgccgagatcatccagatggccgagcacggcggccagctcgtcgaaatagctggagcgcacgtcgatgacggcggcaagcttgtggacgcctgactccgatccggaaccggaggtggtcatcatgtcgacaagcgggataagcagtttgggaggcaggttgtcgaccacataccatcccatgtcttccacgcagtcagcggcatgagagcggcctgcgccggacataccggtgatgagcagcacttcgaaggcatcaagcggggtcggctggttgtccggagtcgatgtggatgtcgcggaattcgccggcgcattcgtggcggccgcctcgccggtatcgcggttcgttgtctgttgattcattacagcgcctcctcaagagctttgcgcatcgcgatctccagctggtcgtcttcggtggtggtgtcctgcagacgctggtcggcatcgctgggcgggtcgtcatcccagataccggtcatcagcaatacctgtacgagagcttggtacagcagcatttcttcgccgccgatggcgtgaccgccatgagcgcgccaggcttccatgagcttggtggggcgtggatcgtagatcacgtccaacagcagtccggagaatggctcggttccggcatcggcgagggcatccgcgacgttgtcggccgcgtgtccgggaatcgtgttgatgacataggtggcgttgcgggctgcctcaagcagggcctgatcgtcgcctaattcgatttcgttgtacgggttatgcacgttgacgaacttttcggccactggtttaagcccggtgttttttccggggtgacgggcggcgacgacgatatggccgatttcgggcatcatgcagcatgcggccaacgccgaagtggcggtgttgccattgccgatgatcagcgcggtgccgcttctcgacgcggtgtggtgttcgccgagttcgcgattggcatggtcgaaggcgagttggatgccgatgacatcggtgttgtatagcttgatgcccggcttgccgttcggccaagcgggatcatcggcagccacgctccagtcgaataccgcggtattcgccaccttcagttccttggcccacaaattttccggaacaccgtacggttggatggtcttcttcaacggcatggtcaggctcaggccagcccacgtcgagtcaaggcctttgaggaaagcgtcgaggtcgtcttcccccacctcgtgcttgtcgtacagccaatcgtcgagtttcagcgaacggtaggccgcgttgtgaagcacgggtgacaatgagtgtgcgacgggtttgccgagtacagcgcaacgatgattggccatatcccctccttgatgtctgttcccatgctagccgacactttgcttcgaatatgtcaaccacaggccccgcaaccgaaaatttactctgggctgctggaccgggccggctcactgctcgtgcagcgcgttgtacagcgcttcggctttggcgtggccgatgcctttgaccttctcgaagtcctcgacactggcttcgcgcatggctttgaccgagccgaagtggttgagcagccgcttctggtagctttcgccgatgccgggaatctcgtcgagcgcgctgcgcagggcgcctttgcgccgctgctggcggtggtaggtgatggcgaagcggtgggattcgtcgcgtacacgctgcagcagatacatgccttcggactggcgtttgaggatgatcggatagtcgtcgtccggcacccacacctcttccaagcgtttggccagtccgcagacggccacgtcgttcacgccacagtcctcaagcgccttggcggcggccatgacctgcggcttgccgccatcgaccaccaccaggttcggcttgtaggcaaagtgatgccggtttgtgttctgctggacgatgtcgggcggggactcccgcgcatcgttctgcactccgaccggcaccgcgtgccccttgccactgatgtcggaaccgccctcaccattgtcgttaccgttcgcagcgattgtctccgccgccacggcagtggtcatcttgccggcggccgaggccacacgctgttccgcgtcgatgctttcgccggagtcgccggcgatgttgccgtgcttgaagcggcgggtgagcgtctcgtaaagcgcggacagatcatccaccgcgcctttgccgtccttgcctcggatggcgaagcgtcggtattcggatttcttggcgaccgcgtcttcgaacaccaccatggaggccacctggaaggcaccgcccacagtgttcgaaatgtcgtagcattcgatgcgcagcggggcttccgcgagtcccaatgccttggccacatcgttcatggcctgggtgcgtgcgcccatgtcggagatgcggctcatcttgctgcgttgcagtgcttggctggcgttctcgttggcgcggtccataagctgcttcttgtcgcctcgcgaggccacacggatggtcaccgctcccccgcgcagattggtcagccagccttcgagttcctcacggcgggccggttcgacgggcacgatgatttcgcgcggtaccggtgcgatgggtgccagcaggtccgcgcgcccggtggtctcctgacgggtgttgcgttctcgggtggcctgggcgcgtgccacagcgtccgtggccgtgatggtttgcgtggagccgatggcctcgcgattagtggagatggtcgcggccgactgggggtgattgtccccggcggcgtccgaatacacctgcaccagaaggtcggccatcaagtcggcgtcatcgatgtcctcaactcgttcgacgctccagttgcgttcgccgcgaatcgagccggcgcgcacataaaaagcgtgcacggaggcttcgagctcgtcgctggcgaagccgaacacgtccgcgtccacatcctggtcgaagacgacggcgttctgttgcaccacggtttccagcatttggatctggtcgcgcagtcgggcggctttctcgaattcgagttcggcgctggcctctttcatgtcgcgggtcaactgggcgatgtatggccgtccgagtcgtccggtcatcacgccgaccagctgttcgcacagcctccggtgttcgtccgcttcaatgcggttcacgcagggtgcggagcatttgccgatggaagcgaacaggcatggccgtccggtcagttgcgccttatggaacacgttggtggtgcaggtgcgtaccgggaacgtgcgcagcaaccggtcaagactgtgccgcaattcccacactttggcataggggccgaaataccgggtatcccgccgtttgcgcgaccgcgtgacccacacgcgcggaattcgctcccccgtgctgaccgcgagatacggataggtcttgtcgtcgcggaactgcacgttgaaccgtgggtcgaattccttgatccacgtgtattccaacgtcagtgattccagttcggtggcgacgaccgtccactccagactgcgtgcggtcagcaccatggtctgcgtgcgcggatgcagcagatacagcggctggaaataattggtgagcctgttgcgcaggttctttgccttgcccacataaatgacgcgcccttccccgtcgcgccatttgtacacaccgggtttggcgggaatatccgaggtcttgggtcggaacaggtcgcgagaatcccccagcaaaggtgccccattcgcattcaccttcgccgtcgtttccccggcacccacagctacgctttccgacattaacgccgccgcagtcttccgccactcatccggactatgccgctcaatatcgttcgtcataatcctcctcgctattaagccaatcatcagggattgggtgggttggggtgtgtgttgctggaccgtaaagacttggcctgagcggcccggagcgtgtccagcaacacacaccccaacccacccgaggtcagctgcaatggaaggctaaagcatgggtttcaggaacttgccggtccatgaggcttcgcattcggcaacctgttcgggcgtgccctgcgtgacgatggtgccgcctccgtcgccgccctccggaccgagatcgatcagccagtcggcctccttgatcacatccagattatgttcgatgacgatgaccgtattgcccttgtccaccagggactgcagcaccttgagcagcttgttcacgtcttcgaagtgcaggccggtggtcggctcgtcgaggatgtacacggttttgccgtcggatcggcgctgcagctcggtggcaagcttgacgcgctgcgattcgccgccggacagggtgggtgcgggctggccaagtcggatgtagccgaggccgacgtccacgagggtcttcaggtatcgggagatgccggtgtacgccttgaagaagtcggcggcctcctcgatgggcatgttgaggatgtcggccacggtcttaccgttgtacgtgacttcgagggtctcgcggttgtatcgtttgccgtgacagacctcgcagtccacgtagacgtcgggcaggaagttcatttcgatcttcagcgtgccgtcaccgtggcaggcctcacatcggccgcctttgacgttgaaactgaagcggccggggccgtagccgcgcacctgggcttcgggagtcttggcgaacagggtgcggatcttgtcccacacaccggtgtaggtggcggggttggatcgcggcgtgcggccgatcgggttctggtcgacgtggatcaccttgcgcacctggtccacgccttccacgcgcgtgtggcggccgggtacgatgcgtgcaccgttgagcttgtcggcgagcaccgggtagaggatcgtgttgaccagcgaggatttgccggagccggagacgccggtgaccacggtgagcacgccgagcgggaagctcacgtcgatgttcttgaggttgttctcgcgggcacccacgactttgagcacctgggtcttgtggatcttgcggcgcttggcgggcacggcgatctctcgccggtgggcgatgtagtcgccggtgatggagcgcttggcttctatgaggtgcttggcggggccggagtagatgacttcgccgccgtgttcgccggcgccggggccgatgtcgaccacccagtcggcgcggcgtatcgtgtcctcgtcgtgttcgacgacaatcagcgtgttgccgagatcgcgcaggtggtgcagggtttcgatgaggcgttcgttgtcacgctggtgcaggccgatggacggctcgtcgagcacgtacatgacgccgaccagaccggagccgatctgcgtggcgagtcggatgcgctgcgcttctccgccggacagggtggcggccgcgcgcgagagggtcaggtagtcgaggccgacgtcgttcaggaagccgagtcgggccttgatctccttgagcacttcgccggcgatcagctgtgccgagccttcgagtttcaggccgttgatccaggcgagttcgcgtacgacgggcatgtcgcacacgtcgaagatggattttccgtccacagtgacagcgagcacttcgggcttcagacggcgtccgtggcagacctggcagggcacttcgcgcatgtacgactcgtagtattcgcgcatggactgcgaatcggtttcgtcgtggcgtcgcatgagcgtgcggatcacgccttcgaagccggtggagtattcgcgcaggcgtccccagcgattgcggtaggagacgttgaccttgaagtcgtggccgtagaggatgtcgtgcttgacgtcgtccggcaggcccttccaaggggtcttcatggagaagcccatttccttggccagaccttcgaggatgtggccgtagtactgggaggtcatcttggtgccgctccacggttcgatgacgccgtcggccagtgacttgtccgggtcggagatgatgagatccgggtcgatttccagtttgaagccgagaccggtgcaggcggggcaggcaccgtagggggcgttgaaggagaaggtgcgcggctcgacctcgtcgagttcgagcgtgtgcccgttcgggcagctgcggtgttcggagaacggctggcggcgggccgggctgccttcctcctcgtccacgaagtcgatgacgatgctgccgttggcgagcttgagggcggtttccaccgagtcggtcaggcgttggcggatgccgtccttgaccacgagtcggtcgaccacgacctcgatggtgtgcttcttctgcttggtgagtttgatgtcgtcggacagctgcgtcatctcgccgtcgatgagcgcgcgggcgtagccgtcggagcgcagcagctcgatcatatccacgaactcgcccttgcggcccttgaccacgggcgcgagaatctggaatcgcgtgcgctccgggtagccgagcagtgtgtcgacgatctgctgcggggtctgggaggcgacgggctcgccgcattcagggcagtgagggatgccggtgcgggcgaagagcagtcgcaggtaatcgtagatttcggtgatggtgccgacggtagaacgcgggttgcggttggtggtcttctggtcgatggagacggccgggctcaggccctcgatgaagtcaacgtcgggcttgtccatctgacccaggaactggcgggcgtaggcggatagggattcgacgtagcgtcgctggccttcggcgaacagggtgtcaaacgcgagcgaggatttgcccgaaccggacaggcctgtgaacacgaccatgcgattgcgcggaatcgccaggtcgacattcttgaggttgtgttcgcgcgcaccctgaatcgtgatcttgagatcgttcgggatgtgcgagatatcagctaccagcgaaccatcgtgttcgatcagcggcgcctttttgatctcccggctcaggaaggagtcgctggtcatcaccttttcgacgatgacctcaccgttcttgcccttgccggttttcgcgcccgttgcgcttgttgcgcgccttgcgccagtccgcgttgccgccacagccacgccccaccttccatctcaccgttcccgcgcgcacggttatgcgcgcgccaaatctgtcccaaggatacccgaacacacgaccaaattcgaacgcttgttcgatggcgtgtcaggccggaaaaccgaaccatagtatgcaaaattccggaccatcagtggaccgaaacgcaagagccggcccccaagatactcggggcgtccggctctcacttccatttccccagcggggttggcttaccatgaagtatacacggttttaggacatcaatcactgtcgatgaacactgttcgaacatggccgaggaattcatcgtatcttccagtaccggcctgggcatcaccgtacgctcctagcagctgatcagggagccatagccttgcatcagtctcccctgcacagagttcgacacgaattggcccgataaatctgcggcttctcaatccatcgatgaaacggatatcgttcctgtcctgtgaaatctcgcgccgttcaagcacaagcgtgtccacgttgtattctgtttccagcagaggcagaagacgttccaaacatttacggcgagcgcgttcggcggtattccactggctcattggtaccgcagccacaatgacatgatcaatgtccattgcagccatggcatcaacgactttgccacgcaatgatggccgcatgtctcgccagtgcaatttccttgctcctttgggcttaagcaacgccaatctttgccttgtttcggtttccgtatcatcacatacgcatgcgcccatcaagtacataggcgagggaactccggttttccgcacactctcgtcaccccaagcggttgccatgtttgtcccttctcgcgcaacgcaaaacaacagttcgatagtatcggatagcagtgccggaccttgcagctatgcaatgccgttgcattattaatcggaaggcataatgtgagacgagaaaaagctaagccgttctagctcttggcaacatccccaatcactcagcctaaatcggcaaatcctgattttcaatggactccacggggatgccaagcttgcgtaattcgtcaactgcatcacgcatgggaatgcgttcctgttcgatacgccgataagcgattgttttgtcagcacacagtcgttcataaagacgtcgctccgccgattgaaggccgggcgtcggcttaggctcccgcatagcaatcttcgcgctgcgttcagtacgatcggtaccaaatctgtggtaccgatcgtatgcatcgcaatccatcaggatggagtcgcattcgatacctgattcacgtaatgtcgaaagtatttccagtccatccgcatccatatcaccccaatacacgatacgcatgtcacgcagtgcaggaaccgcaggtacagcatcgcttacagcgcgaccagaaccccatatgcagatgccctgcgcaatcggcggcatagtctgatacgtgtctttgctctcaacgatgacagcatatttaatgccggataacgcttcgccttcccacggacaccatatgatgcgttcgagctcagcatcgtcgcggaccggatcgagataacggaaccgcagttcggtcggccgttttgacagacccaacgtttcgacaccgagcagtcggcaaatggccttacgacgattggtttttgactcattcagccatttgccgctgaatcctgtcagtggaatctgtcgcggcgtcataccggtcacgtcatgatgcctgaaatatcgaactgcgctgacaagcagatcgaagtcgtcaggctgttcatggcctgtcatgcgagcggccgattcgattgtttccggagcaacgtcacaagcagcaaccagacatgctatgcggcggtgcgcttcgcgatattccgccgccagcgtacgaccaaccacacgcatggctattgattcgtcaggaacgacgactttggagatcaactcgaaagaggtgcctatggtgcgatgcttggttatgatttcgcaaccattcttgcttgcccattgccgtatctcattgttgttgtcatgcactgcaatcgcattggtttccaaaaatgcttggtccggcaatcccaccggcacgggaaacggccatgccggttcgatgtcgtacatatgtgaacgcatatgtttcttcacgcatgtggtgatcgcagcgatgtctttcatgccggccatagttcccatcacctgctttcgaacatcgtcgagtcgaaccgaatcgtcttaataccggcgacgccgggactgctcattcggcaaccccgtcatccttcaatatatccgacgatgattcatcgtccatgtcattctgatgcagcacggcctcgcgcagggaggtgaggccggtgtcggggtccttgtaggtcacgtaggccttggtggagacctcgaggatttcgccggtcttgctttccggagcggagacgatgacctggaacccgaggcgcggcagcaccgtgagggcgcgctgcgtgtaacggccgtcggccttgatgagcgcctcgtcgaggaacagcgtggtgtacgagggctcgctggtcaggccgccgccgagcaggtagatgagcgccgcgccgtatacgaatgaggtgagctcctgcaaggcgccgcccgaacggccgccggtggaggtgatgcgttcatccgggccgtcggcatgatgcacgatggcgtagaaggacgagcggcagcgcgggtcgaggttgcgggcgccgtagcttttcacgccgttcgcgtccttgacctgcgcgagttcggcgcgcagcagcccgaccatcggcgcgcaggccgcgaaagccttgcgcgaggcgtcggaatcgttgacgtcggcggatttccaatcgttcagggtgccgatgacgcggatgagctgcgcccagaaggtgcgctcgggacggcgcacgtccgcgtgcagggacaggctgccgtgcttgggaccgaactgctggcctttgagcatggcgttgatgcggtcaagctggtcgtggatgtcgctggcatccgtgtcgatggcgcgtttgatggtcaggaagctcctgagcagctgttcgaggcagcgccggtattcggcgtcggtggcggcaaccgcggccagctgggtgaggctggcgagttcgtcgagatagtaccggtagtcctccacgctggcggtcagcgaatcatcgtcggccgcgtagagcgcgatgtaggtgctcatcttcgattcgacgccggtgcgtgcggcatcggcctggccgttcagcaggttgatgcgggaggccatgtccttgccgatgccggcgatggtgcgttcggggaagctctcccccggtgcctgcgttcctgccgcgcccgcgccgatgatcatgtgcgcgcgcatggcggcgtccgccagtccggcgaatcggttgtcgtaggattcggcgagcgccgccgtgacttcgtccggcagcgggacggacgcggcgtcatcgtcattgtcggcggtggcaccggcggcgtccgtcgtgccggtgtcggcatggtcgcgcagccagatgagcgccgcttcgacggcgctgccggcgcgggccgcggcctggtcggattcgatgcgctggcgttccacacggtcgagttcggcgttcagttcgtcgcgctgtttggcgagttcggcgagcttgggatcgtttttgatggatgcgatggcgtcctgcgtgtccgtgatggtccgttgcgcgccggcgatgtcgatgcgctcccaggacgtgtaggcgagctggttggccagttcgagttcgcggtggaggttatcggactgtgttttggcggccgtgtagtcggtgtcggcttggctgagcgcgttgcgggcggcgtcgacctgcgctgcgagcgcgttgaggtaggtttcgttgacgaatccgatgacctgggcgcggtctttggtgccgtgctggccgcgtgcgccggatttgatctgaccgtcggcctgcacctgacggttggtgcggtcggtgtcgtcgatggcggtgacacatagggcgtcgaatcgttcgtcctgggtctgcgagcgcagccagtcggcgaagggcgagtcgtcgcggtagcgcagtttgccggacagccagtcgccgtcctgttctccggtgagtatgttcgcgtgcgcgccggtgtcgtcgtagtggcgtgcggtgtccacgaactgccaggtgcgtcggggcatggtgcgcgggtcgatggtgctgactttggcggcgaagccctgttcgtggcgcttgtcgacgaggatggtctgggcgatgggcgcgtaggcgacgttcatggcgagacgccagtcttcctcgtgttcgttcacgtccatgagttcggccacgtacggcagttcggcgggggtgagtccggtggcgcggcagagcatggcgcgggtttcgtccatctgctgggagatgcgggtgcgctgggagcgttgccggtcgaagtcgcgttgcagtcgttcgaggtcgccgcgtgcgccggcccgcgcgttgatggcggcggtgagggcttcctcgcattcgccgtctcgtttgttgtattcgcgtttgaagttcacggcgttgatgcggcgttcgttccaggcttgttcgtcgccgggcagcgtctcgccgatggatgcgaacgtttgttcgattcgtgttcggttggcttgcacgtcttcgagggtgcggcgggcctggtcgagttcgagttcgagtcgggtcaggttgccgccgtccagaccctgcatctggccgcggatcatgtcgagacgggtgcgcaggtcttcggttcggcggcgcagcagcttggcttccgcctcgctgttctgttgttcggcgcggtcggcgggcagttggacggcgacttcgccgcgcatgcgggccaatgcccagtcgcgcagcacggccggtaccgtgccgtcgacggccggcttgaccggttcgaaggcgcgggccttgccgcgtgcggcggcgtattcgccgtaggcctgttggatgccgcgcagcgtgtccatgcggcgggtcttctcgtccatggcgtggaagttctcgtcgtaacgttcgtagtcctcgaccgtggtgcgggccaggtccagggcttcgggcacgccgagcacgccttgtttgaagatgtcgtcgagccgggagggcgcgtcggcggactggatcttgtgcagcagtcgacaggcggcctcgctcaggcccattgcgctccagatgtgtgtgtggaacgcttcggcgctggggaatgtgaggcagtcggggtaggtggctttgagctgggccggcgtgaacggggcgtcacggtattggtccatgcgcctggggtccacgggcttgccccagaccacgtactgtcggcgcacgtcgccgcggccgtcgccgggcatcaggtagaggaatttggcgcaggagagcacctggccggtggtctggttgcgataggtgtccacgatggcgccccacacgggttgcggtgcgccgttctcgtcgcggccgcgcaggtagagcggctcgtcgccggtttcggtgctgcccacgccgaccatgccgcgcaggtaggtgtagtcgctgcgttcggagcggccggagttcgaggccttgttgaacggcgtaccggttgggtacagcagggagatctgcgcgtcgaccagcgtggatttgccggattcgctggcgccggcgagcagggtcaccggcagcttgtggtccgtggaggggcggaattcgtggtagccctcataggagccccagttgatgagtcggcgggattccagcatccaccggtccgcgatcatctgcacgtctgtcgcctgcatcattcggctcccttctcgtcgtcatcgtcatcttccgtgtcgccgtcgccgtgttccgcgacgtcgagccaggtgtcggccagttcgcggtcgagcaccacgggcacgagcggcgtgatctggtacatggcttcgtcgtccaggcgcaccaaatacccgtaggtgatcatcgcggagacgatggcgccgatctgctttgccacgccttcctcgtcgttgcgggcggccagatagccggcgccggtggcgagcgcggcgcggatctcctcaaagctgacgagccagtcggcggggtcggcgtgcacgttctcgtattcgaggacgcggatgcgcaggaaggcgagcagcgcggcctcctcgcgtttgaggctgacacgggttttgagcgagcgcagggtcacgtcgtcgccggccacgggcgtggcgtacatgatgcggtagcgttcgttgatcaccaagtcgagcaggtcgttgttcagggagcgtacgacggcgtcgcggttgtcgagcacggtgtcgtaggtgggtccgctgatatagcggtcacgtttgagggcgatggcggccatgcgtgcctcggccggcatgtcgccggtgtcgccttcgaacagggcgtacgggttggcgttgtccatatgctcctcgtgttcctcgtgttcctcgtgttcctcggccacggtcatccttcctccacaatgatgctcagctcgtccatgtcggccagcaccggtctagtgatccagttccggggctcgccgtcgatcgatacgcaatgccaggtcgcggtatcgccgcgctgcgccggggccggctcggtggcgatgtcgctgtcgaccccgacgccgacgccgtcagtggacggctcgtcggcgatggcgttgccgcttacggctcccagcccgcccaggaagccgacgatctcgctttcgcggcgttcgctttcgggcagccggttgaagctggcggcgatgtccacgagggttgcgccgggcctgtcatcggacctgtcaacggtcaccgggttgcgccggatgaggctgaccatgcgcaggagtcgggggccgccgctgttgaccatgtcccgcagatcggccaccggagtcgactgcggggcttcggcggcgaggtcgctcaggccgggtgcggtggcgcgggtcatggatttggccgggcgcatcggcaatggcgcgaacagcgcgtccgaggtggccgtgtcgtacgggcgcgaggcgtctcccatatgggttttcgcatccgcgttgaggcgcgcgtacagtcggttcaagcgggtgagcatcgtacggtagcgagtgtcggtttgctggcgcacgagccggctgatcgcctcgtcggagacgcgcatctggcggcgcacggcttcgatgccgtcgtagatgcgggccagttcgtcgcggatctggccgagcagcacgccggattcgccggccagatacggggttttggcgatggcgcgcagggcttcgtcgatttgctggcgaccctcgtcggtgatgatcacctggaaggcgtcctcgaagcggcggccgctgtctgattcgcggaacgagcggcggtattcatcgtggtagcgggtcaggttctcgtccacgctgatgtcgccggcctgcatgcgccgacgcaaggcgtcgccgttgtcccgctcgtcgagcacgagttcgcgcaggtcgatgggcacgccgcgcagcgtgttgtggatcacggcgatcacgtcctccacctgggcttcgctcagcgtggcatgctgcttgccctgttggatgcgtttgatctcgtgcttgcgttccttgatttcacggttgaggagtttgatgcgctcgccggggtcggcggtcagctgcatgcgcgcgtgctcgatttccatgatgatgctgttggcctgcgcgccggacagggcgcgtgattcgtcttcgagcctgctcagcgcctcgatggcgcggtgggcgcgggccgtcaaacggtagaggaatcggtgtgaggccgcatcatgcgagttggcgagccaggcgtagtcgccttcgccttcacgggtcaggtcggcgaggatctgatgggcggcctcggcgaaggtctggtcctcgcgcggcgcatactcgccggcgtcggccagactgctcagactttgcgcgaaccgctcctccacggtctcgcgcggcagctcgccggtgagcgggtcgaacgtggaacgcagcagcgacacgtacagcatcgcgttctggcgcaacagcaaccgcaggacgcccgtctcatacaccggtcgcagccgttccagctcccgcatcacatcggccacagcatgcctccctctgtcgtgaccgcaccatactagccgatagccgcgaaccacaccccgcccgcgccacgcccttcgcccccccccacagggaggggcgccaagggcggattctagtggtggttgcaacacctgaggtttgagcggccttccatggtcacgttgaccatggaaggccgctcaaacctcaggtgttgcaaccaccactagaatctgcctatgcggcggcgagatagatggcgcttgtggtcttggcgacgcctcccttggcgtttgcgatggtcacgatcatggttgtttctcctatcggtatttcggtgttggattcgtatcggtattccggtttttcggtattccggtttttcggtattccggtaattctggcgtggtcaaaacaggacgccttggatggccggcggaaccggcgtcgcgtcggtgaagctcggcgcgacagacaggcgttcacgtttgcgacgttgcaggcgcttgcgctgccgccagtcgctggagtccgccagtctggttcggtcggcccagtccggatgcctttcaagccagtcgctcacccgttgcgcgggcatgtcgtgcagctggcgcgccgtgatgccgaggtctcggcagaccagtttcgagagtactgtgcgacgcctgtagtcaaggcctcctatgaggttgcggtccttccatccgccgacgagactgtcggcgatgcaggtggttcgcagggggcacgtctcgcacaccctgcgcccgagcgcgcgcttctcggcatcgacgacctcacggcctcccaccgtaatggtcgcccacatgcgatccgcgaggtccgggtctcgccgcgcgatcttcgcgcagggagcctgggccgtcatgatcccgccctcgccccggcgaacatgtgcccgccgttcgccttgcgtatgtcggagagccggcgctccatctcctcgcatcttgagcagcttgaccggtttccgatagtccgtgagggtcgatgccagcatgttcctcgtggtcatcggcttgttgatctccatgattcctcctcggcgggcgcggcgacggtgaaccggctgacgacctccaccccgaagggcagtgggcggccggccgatagggccttgtgcgcccacagggtcgccgcgccggacgggtcggcgtcgcgcgccgtcacggtatggcccagtcgggcgagtgcttcggcggtgccgatggcgctggtgttcttgccgaccccgcccttgaggttgacgaaggccaccgttaaatgaacctccgttaaccttgtctgttcatcccctccctcaatcgttccggtcatggccccgccgcctcttttttcaaggggtggcggggcttccgaccgcaggaataacgggaggtagccaccggttggcccggcagccaccaacaagcctcacagacgacacgccgaaccacggagcatggcgtctacaaaaaatccggaagtatttcccggcaatacgggtacacgggagtgcggggacacgggttcacggggaaatgggtttcctttgcgaaatccatggaaaaggcccgtaccggtttcccgatacgagccataatcagccattcatcgatcagtgatggtaatagccatcatccttgccggtgcagctgttgccgcagccgtaagcgccgttgaggttcggctttggggcggagccgccggccgggccggagccggacgtggagccggagccggtgccgcccgatgtggtgccacggtatgtgttggagccggaagtggagccttccgtgcgcccgtacgcgtcgccggagtaggaggagacgccgctgtaggtggattgggcctgcgcctgagcctgggctgccgctgctgccgctgcggcggcttgcgcatccgcgtccgtctttgcctggacgctcgcgttcacgccattgatggcatcctccagcgttttgcgcgccccgtcgatcttcgccggatcgttcccgtccttcagcccgttcgccgcgtcgatggcgttcgacaatgcgtcgcgggtggcgttgtccgcgaccttgccgtccgaatccgcgagcagcttcgacgcctcgtccagcttcgccgtcagattcgttttcgcggtttccagcctcttcgcggccttggattcgacgacggccctcaccgccttcgacaggctcttctcgtgggtctcgtaccagtcggcctgttcattgagcttcacggcggcggcatccagtccttgcgcgttttcggccacgcagccctcgtattcgggtgccatggccttgagctccttgcccaaggattcgacggtcttcgagtccttgacctgttcggccttgacggcggcggcatcggcggcatcgccgttgagcagcgcgttgtattcattggcattgttgcgcacggtgtcggcggcggtgacgcacgcctccttggcctcggcgagcttcgcgccgctgtaagcgttccagccgatgatgccggccgcgatcagaatcaccgcgcagacggccgcgaccaggggcggcagccacttcggacacttccttccatccttgcttggctctgtgatgttctcggcgggtgtttcgacgggttcgaggatttccgtcttgtcgttctcgttcatcattgttctccttgcattgataacgctttattgatctgccgggatacccgcgtcggattgcagtgtttcccgcgcgatgtcgagtagccgctcgtcgcggccgggctgggcgtccgctgtgtgggggagccagtcctgatcgacgtcgagggtcaggtcatcgaaggcctgttgcccgtcatcgcggcccagcagaccgcgtagcctgaacgtctcgttcatgtgctgtccgtcccattcgatgcgccgggcgtacagcaggaaatccagagtaaggaaccccggcccggccttgtccacctgcacgtaccgggagcgcgtcggcgtgaatctcacccgcggcacgcctttcagccgttcgtgcaacggactgcccggcacgatgtagcgtttgaccaggttctgtccgccggccgcgaagaacagcatctgcggcagattgccgtaggtcgcgtcgtagtagcgccatccctggtcgtcccgccatttgcgaagcatgtcacgggcggcccccggccccagatggatgccggagaaccgttcccacgccagcgtcacccggtcgaactcgccgcgcatgagaccatacagggcccgcccggtctggtccttcggatgacgtctcgctcgggtgtccgtccgatggttcggatccgcatacgggcagtgcaggtaggcgtcctcgtcgtagcggcacaggcccggcacgtcgccccggtggtgccgcccgtagggccggcgcgcacggctttcctcctgccggcggaacagaccgacgatctggatgggattgtcgcacagcgggcacaccgcgtagtaggacggccccttgtcgccgtcacgacgccacggggccacgccgccggtgcaccccatgtatgactcctggctgatcacgatgctttccgcccttcccggccatgccttgaacacatccatagccagctcccctcgccgcgcatcgtcgtcatcgatacctcctgttgattctaacccaccaatccgccggcagctcgggcaccgcgccctcgcgttcggcgaacgcgaggcacgcgagcaccgtgcgcaatcccaacgggaactcccgtcgtccctgacgcatcaggaacgtccagtcctccgtgcactcctcgcaatccgaatggtccatgatcccgcgacgggccagcacggcccgctcctcgatgtcatccgtcatcatccactccttcttccgtcttgcttcgcctcggcccttgcgtccgccgcgtcgaggggagggcagtcgcattcgatccatgccgtgagcatgtcgcggatggtggtgccgcgtcgcacggcctcggccttgaaccgtttcttgagcatggggtcgagctccaccgtgatcttgggcagcttgaccggtttcttgtagtcggtgagggtcgatgccagcatgttcctcgtggtcatcggcttgttgatctccatgatgttgttcctttccgtgtccccgtgtccacgggtttgcgtggacacgggtttccgggtttccggttctgcgggtgtcaggcgttgaatgcgtcgctgagttccttggcgataagcccgtagcccgaggcggacgggaaccggccctcgtccggcgcgagacgcatggcctccttgtacgggatggtctccctgcaatgggccagtccgttctcggccaggaactcctcggcgtgcctgaggctgcgcgtgccgtagcgggtctgggtcagcagcaccgaggagggcttgttgatctgccggatggtctccagcatgcgttccaggtcgatggggccggtggtggtgacgagcagcacgaggtcggccgcgtccaccgccgcctccaccagatcggtctgcaagggaggcgtgtcgatcagcacccattcctcctcggcgggcgcggcgacggtgaaccggttgacgacctccaccccgaagggcagtgggcggccggccgatagggccttgtgcgcccacagggtcgccgcgccggacgggtcggcgtcgcgcaccgtcacggtatggcccagtcgggcgagtgcttcggcggtgccgatggcgctggtggtcttgccgaccccgcccttgaggttgacgaaggccaccgttttcgtgttcgtggtcattgggattgttcctttcattcgggtttccggcttcccgtgtccacgggtgcacggttccacggtttgccgcgtatacgggtttccggaatggttcgtccttatggggccggaccggttatctgtatcggattgtcttcagaagagggtgtcctgcaagggcggggtgtgtgtggcggcggccggggccttcgccttgccggtcgagcgtgtggtggcgcgccatcgttgctggcgtgcgttgcgctgctcggtcttgcggcgtttgcattcgcgttcgcgtgccgccgccacgatctcggggttctcgcggatgaatcgcgcaagacgctgttcggcgttcgggtcgttcggatcgaaccggaatccggcctcccgcgcggtcttcagcacctggcgtcgggccctcaacggcagtccgccgtagatgccgtactggtcccggaccatgatgccgaacgcgaggcattcggccctgaccgggcaggcctcgcagatccgcaccgccgcgcggcgcagctcgtattgggttcgctggttgggcaggtcgtcgggcccccacatgcggtccgaccacgagtcggggaaatccgcgcattctcccttcaggaacatgccggcacctccttcggcccacggccgccgatgaagccgaaacggacggacgccggcccggtcccggacggcttccgctgcccgaagccgtcgtccttctccctggattccgcgtccaggaaggcgcggcccgcccgcaatgcctccagcacggcattgcgttcgccttcggcatcgttcgcggggacgcgcttcaacagccggcgcagggtgcgcggtgcctcgaacccgtcatttcccgcatcgaagtcgtaagggtcgagcagtttccacacgcgccggtccaggttgtcggggatgccgtagttcggcaccttcggcgtggattccacgctcggcggctgcgccgtttcgcccttgtcggcgaggatgccgtgtccggcgagcaggcgacgcccgtgggggtcgtcggccatctggaggcatacctggtcccagtgccgtgcgagggaacgcgggccggtgagcgtgcgacgccagaaaccgtcatacggtttgccggaagcgtcgcccttgtcggtcttggaaggcggcagcgacacccattcggccacggccagcaccagtggcatgccgtggcgggcgatcagccgtcgggcggcgtcgagttcgcgtttgccgggccgggccaacggttcgggcaccggcatcggcggcatggcgcgcagcccgtccgccatcgtgcggcacaccgcctccgcgtcggaaccggccccggcggattcgctgctcgggggttcggctccggcggcgtcggcccatgaaccgtcctcgcggattccgtcatcgtccggggaggtctctccgcttgcggggagatgccccgtaggggcagaggggttattacgtactagggacgtactgtagctcaccaggtgagctgggggtggggtcacagctgtgaaccgtggttcacccgtgagctggggttttcccgtgtccccgtcgccataaccacggtccacatgtgagccggggtttcccctcgccctgttttccgtggaaggccgtccgcctcgggtcgagtcgatgtcgttcgagtcgaagaagtcggggtcgagctccagacggttccccaggcacagatcccacacgacgggccggtgccactcgctgaaatgcccggcctggcgctggtcgccgcgacggatcagcccgttcgcttccagccatgacaggtggcgtttgaccgtgctcacgctgcacttgcaccacgcggccagcttcctgtgcgtcggatgcgcgttgcgcccctcgtcgtcggccacgttcgccagacacatcagcacgcgagcggcaccgttgtgcctggcgtccacgggcgcgaacctgagcgcccaatcgaccgcgttcacgctcatgcggcaccccctcggcgggagtcttgcagacgtgcgcgcagcatgggcacgcgcggcacgggaacgtcgagcatcatcgacaggtagaagtcgtggctgccgtccgacgggcaggccgccaacaggcccgaagcgaacccatggggcgggaagccgccatgacgcgcggcacgctcatgcgtttcatgcgctctcatggctctcctcactcacggaaccggccgactcctcacgccaacgggcctcaagcatgtcgcggcgcgtggccgcgcggcacagggcgaacgtcagcagataggacgcggcgagaatgatgacgacggcgatcacgagtatgaggtgcatcatcggcccgcccccattgatcgcgcgagggaggccagcagacggaccgcgagaagcacgatgccgactgccagacgcaggaacggcagcagcaggccgaaacaggccactgcgagcaccacgaacagcaggatcaccaattccaccactcatcacccccgctcaccgaaggatgcctgagcatcgagaacaccgcgtcatcgccgctgagggcctccacgtcgcgcatcaacgcgtcgatctcgtcggacaccatgcccgcaccggcctcgtagccgcggttgaacacgcaatccgacggaccgccatggatcagacgacggttcaccgtccgagccggcgacgaagcgttccgcacgtcacgaagcgcgtcatgccggccgatcagataggcgaccgccatgacctccctcacggtcatcgacgcatccacggacagggacaacagggacatgtagtcccggaaattcgagcgctcctcgttatcgagggaacgcgcgccaacggtcatggtcattgcctcacctccgcgtgaagggaccagaaagcgaaatcccaggcatcgcgcgagttacggtcgcaccagcaacccacacaagccaggccgcaggccaccggcaccaaagcgaatcccggcagaagcagattcctcgcggcaagcagaatcgccagaaaaaccacgcacgacaacgcggccagcatccaggagacaagtcccagcagctcgtagcgccgggcagaacgtcgccaatacaaagattcggaaaatgtagacgccatgtcccgcgaaccattcgcgggggcgttaccatcaaaatcagaagtcggcacagcgacttcggttacactagacatttgtgcagcctccataatctaaaaggcaatgcgaacgattcaaaagtttggcgactagggaatcgttcaacattggatgtgttgcatacgcccggtttcgatgtaccagatcaagaccgggcattcttttatcagacagacacctcctccggatggggaataacggtgatacccagtacgaaatcagaagaaagaccatagtggtcatgaagaaacagcaagtccttctgctgccaagctgtctcgccattgaccttcttgcagatcgatgacggcgactggcccatgatcgcagcgaaatcgcgataagaaagaccgttctctaccagccactccttcatcgacatgtttcccctttggtaacttgattctttataagatacacattaatgtttcatttgaggaaacgcaaattatgctgtacgataggcgtgtcgcttaaagatacaaatacttttcaaggagccataaatgacaacagttgcacttatgcccattgcggaagaggccgatgctgccgttgcttatgccgaaggaacagtgtcatggaacatcaaaatgatgctcatgacgcagggcaaatcacaaaccgccttagcggatgcgctgggcgtgcaacgtgctgcaatatcaaagaagattcgaggttccgtatcttggtctttggccgacctcgtgcgtgcagcagactttcttgatactgatatttcgacgctgcttgacgattcgctgatgaagcagcttcaggggatgggtaacagaaaagccaccggcgacacgccgatggcttcaggtgagctcctgcggctgggcttgaaccagcgaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcggatactatctcatacagccaaaaaccgaacgcggatatacactagcgactaacggtagaggagctggtgtctgcttggcaaatactggaatcggtgaaacggaacaaccgtctgagtatgcgaacccagtgggaacaatcacaagagttctgatgttccgctgtcactgcatggcagcggttgtgacatggatcggccgcggctgaaggtcgaacaacatgacgatgcggcgatactgtcacgcgaaatttcattgtggataacttcggaagctagaaccacataggtcgttttggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagccggcggcgtcagcaggcgcgtcagcgggctcaggaacggcaacggcgtatggatgccataatcgcgttggccgccgttatcggcctgctgcttgccttgggagtagggctggcatccacgcctcagcatgttgcgcatgcggatactgcggtgaccggagatgcggcatacacggtggaggatttcaccgatatgtctgatttggcgtggcgcaatggcaatcagtgcgaatcccgattcgactggccggtcgacgatccacaggtcgaacaacagttcgagcggccgatcaacccgtgggcaccaggtcatcgtggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatacgatctcccgcagacagcccgtaggcatcgttgaaggcagctcggaccattgcgaagaccgttgcctgcattggggcctcaagcgaggaacggccgattatcttgatccacagcaatatgcggggagtcgaaaaatcgtactgaaaccgtcatgatttaacggtgattgtcggccggaacagggccgtacggaagagacatcgcaggcggctagcggcgtgacgagtatgaatcacagaccggcatcggccaaggaaatatatccggggtcgatcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcgcggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttccttagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgtggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggattccttggccagcttgagcgatgagaccagccggtccacggcctgcgcctgctcgtccgatgcagtgctgtcgctctcagtgttggacgaatcgtctttggacgagtcgtcttcggaagattcaccgtcagaagtagcttccccatccgtggcatcgttggtgctcaggttctggctgatgtaatcgccgtattggcgagtggaagcgtcggcctcgactactggagccacgagcaatgtcatgttgtcgggcgcgatggcaatgccggaatcgtccgtggtgttattcgaaagatgatcgaccacaaagtcttggatggcgcggctttgcttggccaacgagtcggacgtcgtatgatcgatatcgcctttcttgaaaccggcgtcggccagagccttggctaggtcaggcaccagcttcgcccatttgttcagtggcgtctgctggttcagcgtaatgccgtccgaaggtgtgaacacggccacgccgccggcagaattggacgtcaccgtggtttgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaagctgaatcacgattctagtaggccgtatacgaaaaagtcccggaccagtggacaaatcgccacatatccgggaacaattagaggtattacgtgcgtgcatcgaacaactgtcatgattatcgtgctgaggaacattccagatgaagcacgacaatcatgacagtttgcgacatgacatgacccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggatgcgattgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacctgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggtgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcaatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggtgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttctgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatgggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcatccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatctgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtagccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgttgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagcttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgagatcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgtcatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccccgagcatgaaagtggtgcgtcccaaggtattgcagcgctacgccaccgtcatcgaggaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgctgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaagtcggctacgttctgaaccccgtactcgaggagaagtccggcgagcagtatggcgatgaaggttgtctgtccgtgcccggcttgtggtataagacccgtcgtgccgactacgctcgcgtgcgtggcatcgacttggacggcaacgaggtcgtgctcgagggctccgggctgatgggccgtatgcttcagcacgaatgcgaccacctcgacggccacgtgtatttggatcgcctggaaaaggaagaacgccgcgaagccctgcgctacatgcgtaatcgtcaggcgaagtagtccatactcggctcccgctggcgggagccgtcgaacgtagtgagactgagggtggttctgccggtaccgcccgtaactcccctcagtcgcttacggcgacagctcccctcagagaggggagcctgtttttttttagtaccggctccgtgctattctcgaaactcgtgtgccacccggcaacggacgcagtcgctggcgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggcccacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggttccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggcgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaatgagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgagcctaaggcttactccacgcgcttagcgtaatttcaacgaaacgccatccggttattcaataatcggatggcgtttcgctattccaagggtgtcgttgctagggggtgtcgtcgtaaaccgatacgcttgtctacggataatttcgcactttcggttttgagaaaggcacaatatgactgatagcgacaatccgcgcagagttctgctcaagctgtccggcgaagcattcggtggtggcaaggtcggcatcgatacccaggtgattcgtcgcattgccgaggagattgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggcgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtctcttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgatctcggcatcagcccgaaccgtgatggcaacgtcatccgtctgaccatgccggaactcaccgaggatcgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtaggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgcaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtatattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattctgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcgtcgagaaagcggccgaactcggattgccgaagttccgagtcaagcagctcgccaaccattactttggccatttcgatgtgaatgccgccgaattcactgattttccggcagccaagcgcagcgaggccgccgccgcgtttttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatgggctgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaacaccgcgcaggtgttggatgccgcgcacgattattggctggcctccaagcgccgcgtcagtatcgaatacgcgctgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgcgcgggcatcaccgccacactgcgtgacacccgcggtcaggatattgacggcgcctgcggccagcttgctgccaaggagcggtagtttcggtgacggaatcggcctgcggcgattccgtcacttcagcgcatccttgattgcgtccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagccaccagacccgcgttgaccagcagccacgcgccatggcagatcgcggcgatcggcttaccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttggcgccggcggccttgagatcgcgcagcgggcgcgtcagctcggtctcctcgataccccagttgttgacgatgatcagtaccttgctgttttcgacagccatgccaatctccttgattcggcggacaacttccacgagccattctctcacgccgagcggctgccataccggtgctcaatatgatgattctcatattccagaaacaggtgcggcgcatgtaacgggcggtaggtagtctgaaggactgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagagagccgacgagatcaccttcctggatgtgaccgcatccagctcccaccgcaacacgatgattgacgtggtctcccgcaccgccgaacaggtgttcatcccaatgactgtgggcggcggcgtacgcacgcccgaggacgtcgactcactgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggtggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtagtccacaaaaagaagataggtatgacagacactacatacgacaattccactgaactcgatccccgtattgccgcacgcctgaagcgtgacgccaaggggctggtcgccgccgtcatccagcagtacgacacacacgaggtgctgatggtcggctacatgaacgacgaggcattacgccgcacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgagcagtagaacgggctttcctgactgagggaagccgagcgaccgcgtactatgaaacaagatatcgagttgtaagcaaaggagcgaatatgagcgaatgcagcgtcaaacacctgaagtggggcgccacctggcccagtcgcgaacagttccacgaactggccgacgccggctgccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagcttcatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggcccctcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggcttcggacgagtcccgcgtcaacatcctggacgaaacggtcgcccaacccgagctgcgcttccgcaccgagaagagccactacgagcaggccgtcgaacgcgccaagcagcacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcacgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggcgcgcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgaatccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagctgcgcgtaagcgtatggacgcatgagcgtcggttgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccacgtggccaagggagacaagatcggtctggtgggccgcaacggtgccggcaagaccacgctgacccgcgtgatcaccggcgacatgctgcccaccgccggcaaggtgcgcgtctccggcaagctcggctacctgccgcaggacacgcacgcctccgatcccacgcagaccgcgctcgaccgcatgatgagcgcgcgcgacatcgcaaccatcatcaaccgcatccgcaaggccgaaaaggatatgaccgacccggatccggacgtgatgagcaaggccatgacccggtacgacaaggccatgcaggacttcgacaaggctggcggctacgcggcccagtccgaggcgatctccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattctatcgaatggctgcgcggctacttgaagaagtacgagggcggcttcctggtcatttcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggccgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaatctggccatcgacaagggctcgcgtgtggtgatcctcggctacaacggtgccggcaagaccaccacgctgcgcctgctggcccacatcgaggagccggacaccggttctgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtacctcgaactcgtagctgaagaatagtagtaaactcgtagccgaagaatagtagtaggagaggtctgccatgccaaccacaacaggtaagaaaatcgccatcgtcaccggcagcgcgctgggcttgggctacgagctcgccagccagctcatcgccaacggctggctggtggccggcgtcgacttcaatgccgaacgtcaagccgaactgaccgcgcagtggcccgatgactcctaccgcgccttcgtcggcgacatcaccgacgaagcgttcgtgaaagaagccgtggcggatatcgccacgctcggccacatcgatttgctcatcaacaacgccggccagccttcgttcaaggtgcccaccgcctacgaggccgccgacgtcgacaaatgtctcaagggactcaaaggcatgattctgtggacggtggaaaccctcaaggcctgcggcgaacagaatgtgaaaatcgctcagattatgagtacggccgccacgcgcggcaacgcgaacgaaagcgtgtactgcgccaccaagtggggcgagaagggctataccaagagtctgcaggccgcatacaagggcaccagtgtcaaggtggtcgccgtctatccgggcggcattgataccgctttctaccgtgacagtcgcgactacgtctccgaggccaagcagcacaccttcatgcagcccggtccgctggccgaagtcatcctcttcaacctgatcaacgaggccaacctcaccgtcaccgacatcgagatcaaccgcaacagctgagcctgctagtctgagatttcagcgccttggaacatacttggtgccaaggcatttcgcgtgtggagagcgaatgcacatcagtgacgatgagtttgaacgggcaattgaacaggtgttggatgatttgcctgaacggtttgcgcgggtgctggagaatgtcggcatcgtcgttgcggacgaacccaatgagcgcgaactggccacaatgagcaatccgtgcggtgagctgctcggactgtatgagggcatacccgtcacgaagcgaactacgggctacagcggcgtgatgccggacgtcatcaccctgttcaaggggccgcatgaacgcgtatgctcaacacaggccgagctgcgccaacggatccgcaaaaccgtgttgcacgaaatcggccattttttcggcttcgatgacgagtatctgcactcgcacggctactgaagcgatgctagtttcactagcggggagccgccatactgccgtatgttgccaggtctactgcaagtggtgcaacgcacggatgatggcgcaacggtcctcgacggttccctcgttggcgcacatggtggcgtaccaacgcggattgcgcaaggtctcggtgccggtggcctcatccgtggcgacgagcgtgtgcagatcgttggcgtactggaaatgcaggtggctgagcagcccgccctcggcgaacgccttgcgcgaaggcagcggattgatggcaagcagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcagcggccggctcgttcacacgccagtagccgatatggatgatgttctccgggctggtggtggagcaggccatcgaccagaacgtcctgatgccgcgcgcggccatcggggccgtcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgtggtggcgaaattggtagaggcattagggctggggctgctggcatctgggttactgacatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaagatgatgaggtccttgccgcacatcaatgccgagccgatggcaacccgctgcttctgcccgccggacaggctcatcggatgccgttcggcgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgactaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatactgaagtgcactcatccgcggccgggcttgaagccagcgccgcaatccggcgtcgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgaccctgggccccagcatggtggccgccgccacggcgatgcgctgcttttggccgcccgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggtttccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtacggcataggtcacgccgaagttcaacgcggttcgccatcgggcggccgccagcaggggtagcaggaacagcacgaccatgacgatttgcgtggcgagccctacatggaagaacagcatgaggttcgccaccagcagaaggtagagtttcgcgcgcggatcgagcgtccggcgggcaggattcatcaggcgataccggccttgatgaagtgcttcttcatcatgcgctggtcgaaccagccgccgagaaccgcgcacaccagaatcgcgatcatcgagatgaagaacgtgccggtgttgatgttggcgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgctggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcagaggcaatagtctgtctgtgattttttagcatggcttggcgggttctagtgatcgttgcaacacctgacctaccgcaaggagggtcaggtgaccagaagccaccgaaacgaagaccgtggcgccgacagggtgtgggagagtagcacgccgccgcaccacacgtacaggaagcccctcggagcacacgccccaaggggctttccccatatcaggacacccgcgcgtcggggtgtttctcgcgtccttgggccttagcgtctcggatctcccccggtccgccgcgcggacggctccccctcaaagaggggagccagaaacctcttgggccccgacgggatactcctgccggggcccagtacgttttgggcggcaacccgctgaatacccggtaagatggctgaggtatcaacaaacaggtcaggaggtgacgcgcatggtggcgtcaagccgtgatgaccgaagcgtagatgcattggtgaaatccaaggcagtacttgatgtattggcggaactggggccaagcaccgcaaaaaccataagcgaacgtactggtgaacccgtaagctcaacgtatcgtttgctggataatctcgtcgcagtcggttgggtggaacggggcatcaatcgtggcgagtatcggcttggcatcgattgcgtacgtatcggcggccaaatcgaaagcagactggacattcagcagatcgctcgccgtatcttccgcgcccatcgcggccagttcggtatctggggtctgttcgttcggaggcgattgcgcacggtgtgcatcgagacacgcacccgtgagacattgcaaagctatgcacagctggtgggcaatagcttgcctctgagcatgagcgctccctctcatgtactgacggcctggcttcccccggctcgctacgagcagctgttggaacactatgcctataccaacgagctcggcggcacattctccacgatgcgtgccacagcaatgggacaggctcgtcatatacgcgaatgcggcttcacctatgacgtcggccagaccatggccggctccgtgactatcagcgtaccggtattcaatcacgccggagagattcaagcggcaatcgccctgagtggcctttcccgctccttggaacctgagctggcctgtctggtagatgggaaaccggcaacggcatcggctcaagacatggtgcaattggtgcagactgccggccgcgaggtgtcgcgaggccttggatacagtggtgattatcttggcctgaacagttgaatacgatgagtcagggataagtcaggggaaggaacgtcgacgatggcggaagacaaacgtgaaccgacccgcgctttagacaaggctagtcgtgtggtggacgcattggcggcggagaatggcctgtcgccggcagatatcgccgacgcctgtgatatcccgcgatcctccgtataccgcgtgctggatggactggtcgatgtggggtgggccgtaacggatacggatggtaactactcattatcactggactggctgcgattggctgatgccgctcgcacgtctcgtaccgaatggcagcctgcgattgcggtcatgcatgccatcaccgcgcaaaccggcatgacctcattcctcagtgtggtctccggcactgaattggtatgcgtggaatgtgcgcaaggtcatgccatcgattcgctgatcctgcgcccgggccgcgtgctgcctctacatgctggcgcggccggccgcgtggccttggcgtatttcgaggatgccgatgtcgaacgctatcttgcaggagcgccgttcccggcatataacgagaacacgctggtcagtgtggaacagttgcgcgaggatattcgcttgactcgcgaacgtggatatgcactgtcggatgaggatgtgacgttgggtgtcggtgccgttggtgtaccgattgtggacaacgagtccggtcgcgtgatcgccagcctgtccgccggtggattcgtggacgaagtgttagccactcaagaattcttggccgcgttactgcacgatggcgtacacgagattcaggcagcctgattcggcccgctaggctgtcgggctggacggttatgtccggtcagctatggcctttgccggctacggttctgctggttatgcttctgcccgactacgttgcggtccgttacgcttcggccacacgacccaacgcgatggcggtgatcagcacgtacgcctcgcgcgggtcggtggcatcccagccggtggattcggcggcacgcttcaaacggtagcggatcgtattgggatgtacgttgagctccttggccgtggtctcgagcgaaccgccgaacttcaggaatgtggagacggtgagcagcgtcggatcatcagggcctgctgctgtcaggcttccgtagaccacgcggaccagttcgtcacgggcgtccgcgtcgccgatcaacgcacgttcgggcagggcgtcgtcggtgcgtaacgggcgcggcaatggctgcacggtggcggccagagccggcgcggcctgaagacagtaaagcgtggcctgaatcgaacgcatcgcgccatcggcaccggtacgctgcggacccaaggcgattggccgatcggcggcgaacgacggggcgatggtattgcagatgatttccggcgtggccgcaccgaccggacgaatcaacgccactacggcggtgctgttgccgatcgggcgcttggcggtcagacacacaccgccgaaatcggccacgattttctcgatttccttggccgtacgtgcggcggaccgggcagggtatccggcgatggcgtaacaatcgaagtcatgctcgaaaccgaggatggtgaacagggactccactcgttcgtcggccagatgattgaacaggcactcgaacagcacggtgcgtacgcggttggtcgcggcgatgccgggtgcggacgaatcggcaacgtcggcagcaagaagttcgagaaaatctgacatagtcactagtgtagcgtcgctgattggcgttgcctttcagccaaagactctcgccaatacgtcagcaccacgaatccgaatacaaacgcaaccggcaacatgtgccgctcgaaattattggccggcgcggtgatcatcacgcccatcagcagtagcagcggaatatgggtcatgagggtgagccaacgtcggcgaatcacctcggccgcgccgatcagcaatgtcatcaccacgtagaaattgccgtgcgtaggccagccgagtacgggaataccgccccatacgcgagtgaagccggcgatgtgctcacgccagtcatggttgtaatccttgatccatgtggagtttttctgcacgtaatcgctggtcacgtaataatccatcgatacgtacggctgatcgttcacattgaagtatccgaagcatttggccagcaacgcatccagcgcgatgattggattgtccttgacgatttcgaaccatgccttgttgaaattggtcatatcctcgggcgtcaccgtgcgccacttgtagctgaccttcttggcctgaatgccggaggatttcaccgggtcggcgtcctgctgggagtaagcgtcggccatctgatcgagattgaagacgggcgcgaggttctttttggcttcgtctgaaatgccgtccggattgcgctgggccacgcgggcgatcatttgcagctgtacgccgcggctttcgattgggtcgccgccgatgatcgcgccagaggagatggcgaaggagatgccgccgtgaatcagtacggtggggatgagcagcgccacgacgtaagtcgcccagcgcttgcggtcggcgatcagagccagcacgatttgtagggcgatgatgtaccacgcatatttcgcggaaatcagcattaccgacgtggccaggataaaggcgatgaaactgtgacgcggcaagtggacgggcgtggcgatggcaggggtctgaggatgtttgcgggtgccggcggggtgccaggtctggacgagttcataccagacgctgaaccaccagacgaacgagaacgcgaacagcggcgatttggtgatggagatagtggaaaacacggccagcgggcagaccataaagaacagcagaatcaggaatcgagccaatcctccggcctgtgggggagcggcggaatccgttgccgtttttcctatccaaggccggttcaggaatcgattggcggcggcagcgcagcagaacacggcgaacagcgtctgcagggcagccaacgtcacgataccggcatcgtttgagccggtcagatgcctcgcaaacgtgaccatcgcgccatagaacacagtgagtaccacattgtgctggtcggtcagatacgtgggatcggacggccacatgtagtgcgcagtggggtagatgtccatcggcacgaaggagaagaagccgatatagggctgtttcaggccggtccactggttccaggcccagctgaattcacggatctgtgagcggaggtccgcaccgaatgcggccagcagagtggtcggcacccagagccagccgacaaaaaacaccagcataagcttccagaaccggttcgtgccgcgtgtgatccagcggtccagaacagtgacggtggacgtgacgatagcgcgaacggtacgacgggtcttggctggttggctggcctgctgatcggcggcgggccgtgatgtttcgctattccgctgatgttgacgtagtcgctcgccgatagccctcggcagtatgcgctggcctgctgcgaatcgcaccatcagcgtgatgattccgagatatatcaggaatgacacgacgaatattgcggtattggcccagttccaatgggcgagggtgccgttctcctcgtcccagtacagcgggccgaccgccgtgcacagtgcaagccacaggccggccagcacggccagtgtccagcgcgcggcagcgcccgcgcgcgcaagatgcgggtgggactggcggctggatacggcggcaagcttcgcggtggctggtgacgtcatgacaatatatggtagccgcacaggtcaacggttgatattcgatgtctgccgggcatcgccattgttcgcaagccaatatgacggccgggtgcatgcgtggggtcggcgaatgcggaatttccgaagttgtgaacgttaacatgggctatgtgggtgaaaatagttgattttgcgcgcttttccatggaataacgcgggcatatcgcgccaaaatcgaggtaacgtagtgcccatgatgattgcgttgaaagctgcaacgccgcagctacccagaactacagccgtcgcagatcatgtggtcgccgtggacgaaaccgattcgaccaacgcgctggccgtacagatgattggcgacgggtcgttgacgttgcccgaccaccaggatggcgaactggcggtggccgtggtggccgccgaccggcagaccgccggccgtgggcgcaatggtcacaagtgggtcagtcagcccggccgttgctcgacgatgtcctatgccgtgcgcattccgcgcgcgatcgccaccgacgaatccgtcaatggctggctgcagatgatcgccggactggtcacgctggacgccctgaacggcatgatcgaggaatacggtgccgcgccgaaccagccggactgctcgctggaactcaaatggccgaacgacgtgttctgccacgggctcaagctgggcgggctgctctcggaactggtgattccgccgtcgtccggtaccggtactgatgctgatgccgatgacgacgtcgtcatcgtgttcggcgtcggcctgaacctggccttgggcgcctgtcggctgcccacgccgcaatcgacctcgctgcagctgcatgtctccgggctgccgtcgttcggcgagatgcgcgatgcggtggccgaacgtcaggtcgagggcttccgcgagcggttggtgaagttcatcgccgacccgaagggccaggccgagtcgttgcgcgaggaggtgaaggcggtgtgctgggcgcgcggccgtcaggtcgaggcgcacttcacggacggcaccacgctgaccggcgaagccatcggcctcaacgaagacgcctcactgatcctgagaacacaagacggcacggaccatacggtccgcaccgccgatgtgggagtgctgtaatagccggccagtagctagctagtagctcaggtcagcgaccgagcttggacaggccggcggcggccagagaggccaccacggccttgatggcgtcgccaaccacgaagcccatggaggccagggccacggcggcgagcggcgcaccggtcagcgcggactggatgacgaagccgaaggcgtacaccaccacgacgccgccgaccagcgcggccagcaggtagcggcccgcggtgcgcgcggcggccgcgaaggacgaagtgtcggacttgccgcgcagcagggcgatgaccaccacacccggcaggaagccgaagaggaagccggcgctcgggccgaccagggccagcgtggaggtgccgccggcaaacaccggcaggccgaccgcaccggccgccagataggtggcgacggcggcaccggcctgacgccacggcagcataagaccggcgagcatcaccacgaacgtttgcagcgtgatcggcaccggcgtgcccggaatcggaatctcgccggcggccgcggacagccacatcagcacggcgaacagcaccggcttccaggatgcggcgacgatacgacgggcgagcgatgtggtggccgcagcggatgcggtggtgtgtgaagtctgcatatcaatgacccctatgttgcgtgatatcgccgtgaacggcgggcggtatgcgatggatgaggggaggttccggcgggtcgtgcggtatccccgacagtccgaaccgtccatatggtggacggtcccaaatgaatccgaccctgtgcgggcgaatcgtgcggcgatggaccgatgccggtccggtcaccttccgttcgcccgcagatgagccttcccccgaacttacggttgccatcgtagaggtgttcgatttcgtgcggtttcgtaccaatttacaaaattgtcgatttcgatttgtcataagttgacgaacacaaccgtaacgtcaacttcttgagccggcgcgcaaggatgtgcaatcggcggatttgcaacgtttttgatagcaggcgccaacggttacgttgccggaacctacgcgcgcgtttgttcgtagcctacaaaagggcgtgaaagcttttgtgtgaacgcggcttgccctctcctctatatagagagcacaatttgacactatggcttctatcgtcaaaaaactgctgattgcgaaccgaggcgagattgcgcttcgcgtggtgcgcacggccaaggagatgggtatctccaccgtggccgtctactccgaacaggaccgcaatggccgctatgtggacatggccgacgaggcatacctgctctccggcgacacctacaaggacacgtacctcaacgaagatctgctgattgacatcctgcacaagaccggtgcgaatgccgtgcaccccggctacggattcctttccgaagtgccgagcttcgcgcagaaggtcgaggatgccggtgccatctgggtgggcccgcaccacaccgcgctggtggatttgggcgacaagattaccgcccgccgcgtggccctacgcgccaaagtgccgccagtgcccggcctgtccgaaccggtgaccgacgtgcgcacgctgctcgacttcgcacacacccacggctacccgatcatgatgaagcgcactgatggcggtggcggccacggcatcaccgtggtgcatgacgacgaggagctgcgccgcttctacatgaaccacgacgcgctgcaaggcggcgatctgaaggaatacttcatcgagaagttcgtggacaaggcacgccacgtcgagacccagtccgggcgcgactcgcacggcaacttcaccgtgtactccacccgtgactgctcgctgcagcgccgcaaccagaaactcgtggaagaggcacccgcgcccttcctgtccgaggaaatcatcagcacgctcgaggaatactcccgccgcctgttcaccacggtcggctacgtgggcctgggcacctgcgaattcatggtgaccccgaacggcaaggtgtacttcctggaagtcaacccgcgcttgcaggtggagcacaccgtctccgaagaggtcagcggcctcgacctggtgcgcgaacagctcaatatcgccgccggtggcgagctcacccgcgcccccgaactgcgcggccacagcttcgaactgcgcatcaccagcgaagacccggccaccaacctgacccccggctccggcaccttggagaagatccagtggccggccggccccggcgtgcgcatcgataccggtgtggaacagggcgacaccatctccccgaagttcgattcgatgatgggcaaggtcatcgtcaccgcccagaaccgtctcgacgccgtggcccgtgtgcgccgcgtgctcgatgagcttgtgatcgaaggcgtgcccacgccgattccgctgttcaaggaaatcttccgcaacgacgacttcaccgccgagcatggccacccgttcgctgtgtccaccaagtggctggagcgcacgtacctgaaccgcacaccggcttccgccgcctccggccagccggcctccttggccgccgccccgggtgccgctgccccggccgcgcccgacaagtccaagtcggagacgttcgtcatcgagatgaacaaccgccgcgtcaagctcaccgtgccactcgacatcgtggagaacatcaccggctcggcccgcgcccgcggtgccaagcgacccacccagccgttgcgcggtgcgggactgcacaacgtggcctccagtgccgctgcggccaacgacggcgccaaatccggcgtcatcgcctccccgatgcaggccgtggtcacgcgcatcaacgtgtccgaaggccagcaagtggccaagggcgaccttctggtggtgctcgaatccatgaagatggagaactacgtgtacgcgccggccgccggcgaagtgaagaagattttcgttggcccggccgacggcgtggaggccggcgacacgctggtcacgctggacgtgaacgccggcaaggccaaggctgctgcggctgcgccgggatctctccctcaggcggctgcgtcgacagctccctcgtcagaaggagccgataaggccaccgacgccaagaaggagggtggcaatgactgacatcatggattcgcaggccgtgaaggccgcggctgcggcctcggccgccaacgccgcacagccttcggcccaccagccgctgcgcaccgctgtggtcaaggccgccgaactggcccgcgccgccgaagagcgcgcccgcgacaagcagcacgccaaaggcaagaaaaccgcgcgcgaacgcctcgacctgctcttcgacaccggcacgttcgaggagatcggccgcttccagggcggcaatatcgccggcggcaacgccggtgcggccgtcatcaccggcttcggccaggtctacggccgcaaagtggccgtctacgcccaggacttctccgtcaagggcggcaccctcggcaccgccgaaggcgagaagatctgccgactgatggacatggccatcgacctcaaagtgccgatcgtggccatcgtggactccggcggcgcccgcatccaggagggcgtggccgccctgacccagtacggtcgcatcttccgcaagacttgcgaggccagcggcttcgtgccccaactgagcctgattctcggcccctgcgccggcggtgccgtctactgcccggccctgacggacctcatcatcatgacccgtgagaactcgaacatgttcgtcaccggaccggacgtggtcaaggcctcgaccggcgagaccatctccatggccgacctcggcggcggcgaagtgcacaaccgggtgtccggcgtggcccactacctcggcgaggacgaatccgacgccatcgactatgcgcgcaccgtgctcgcctacctgccgtccaacagcgaaagcaagccgccggtctacgcatacgccgtcacccgcgccgaacgcgagaccgccaagcgacttgccaccatcgtgcccaccaacgaacgtcagccttacgacatgctcgaagtgattcgttgcatcgtcgattacggcgaattcgtgcaggtgcaggaactgttcggcgcctccgcgctcgtcggcttcgcctgcatcgacggcaagccggttggcatcgtggcgaaccagccgaacgtgctcgccggcatcctggacgtcgactcgtccgagaaagtcgcccgattcgtacgcctgtgcgacgcgttcaacctgcccgtggtcaccctcgtggatgtgcccggctacaagcccggctccgaccaggaacacgccggcatcatccgccgcggcgccaaggtgatctacgcctacgccaacgcacaggtaccgatggtgaccgtggtgttgcgcaaggcgttcggcggcgcgtacatcgtgatgggatccaaggccatcggcgcggacctgaacttcgcgtggccctcctcccagatcgcggtgctcggcgcggccggcgcggtgaacatcatccaccgccacgacctggccaaggccaaggcctccggacaggacgtcgatgcgctgcgggccaagtacatcaaggagtacgagaccagcaccgtcaacgcgaacctgtcactggaaatcgggcagatcgacggcatgatcgaccccgaacagacccgtgaggtgattgtcgaatcgctggccacgctcgccaccaagcggcgcgtcaagcgcaccaccaaacaccacggcaaccagcccctctgatttttgaagacgtcaaccaaacacaagtaaggaaagcaatgaccaccttcttcctcaatcgcctagccaccgagccccatgcgctcgccttcgccggccagtccaccccgtggccggtagccctggcagaccagaccaccgatcccagccttgacgaggccctgcgcggccacgtcgccgcagccggccgactgctcaccccggtcgccgccgacctgctggccaccaccggccgtccggtcgacctgttcggcttcgccccgaacccggcacgcctcggcgccgcagccgacgccaccgcgtccgtggaaggcgtggcgctgacccagctcggcgccctgctcgacctcgaacacctcggctacagcgtggcccaggccaagccgctcgccgtgctcggccactcccagggcgtgctcgccgtgcacatgacccgcgccatcgaggccgccggctccatcgaggccgccggcaagaccctcaacgagattctggccgtggccgccctgatcggcgccgccggaacccgccgcgtgcgcgaactgggcctgaaccccaagtatggcgaagccagcccgatgctctccgtcaagggcgccacccgcgaacaggttgaggctctggtggcccgcgtcaacaacgctcgcggcccgatctccatcgccgtcaccaactccgacaaccaccacgtgctgtccggctacccggaagacctggccgctttcgccctcgaagccgagcgcgaacaccagcatcaggccaagctgcgcgagcagaagctccacggcggcaccgtgttcaacccgaccctcgaataccttgaggtcaccctgcccttccactcgccgctcatggccgacgccgtcgaacagaccgtggcctgggccggcgcctgcggcttcgaccagaagcgcacccgtgcactcgccgaggaagtgctcctgaaccacgtggactggaacgcccgcgtcaaggcgctgttcgacgacgccgacccgtccaagctgtggatcgtggacctcggccccggcaacacgctcggcaagctgatcggcaacgtggtgcagggcaccggcatcggcgtggtcgaagccaccacgctggccgagcgctccacgctctccatgctggaaagcgagcctgagcgcacccagaactggaaggcgttcgccccgcgcgtcatcaacaccccggccggcgccaagctggtcaccaagttctccaagctcaccggcaagccgccggtgctgctgcccggcatgacccccaccaccgtggaaccggaaatcgtggccgcagcggccaacgccggctactgggccgagctcgccggcggcggccaggtgaccgccgaagtattcgaccgccacatcgctgccctcgaagacgagctggaggaaggccgcacggtcgaattcaacgcgatgttcatggaccgttacctgtggaacctgcagttcggctcctcccgcatcgtgcccaagaagcgtgcttccggcgcgccgatcgacggcgtggtcgtctccgccggcatccccgagctggacgaagccgtggccctgatcgagtcgctgcaggcggacggtctgccgtacgtgagtttcaagcccggcaccgtggaccagattcgccaggtcgtgcgcatcgccaaggccgtgtcccccaccaccatcatggttcaggtcgagggcggtgaagccggcggccaccacagctgggaagcgctggacgacctgcttgccgccacctacgccgaagtgcgcgcctgcgacaacctcgtgctggtcgccggcggcggcatcggcacccccgaacgcgcggccgactacatttccggccagtgggcccacgcctacggcctgcccgacatgccggtcgacggcgtgcttatcggtaccgccgcgatgaccgccaaggaggctcacaccagccccgaagtcaagcagctgctcgtcaagacgcccggtattccggccgacgccaagtccgacgacgtgttcgccccgcaggccgcccactgggtgccgtccggcaagtccgtcggcggcatgtcctccggcctgagccacctgcacgccgacatttacgagctcgagaacgactccgccgaatgcggccgtctgctcgtgcgcgtcatgaagcaccccgaagagctctactcccgccgcaaggaaatcatcgaagccctgaacaaaaccgccaagccttacttcggagacctggcctctatgacctaccttgagtgggcgcagcgcttcgccgaactcgccttcccgtgggtcgacccgacttacgccgaccgcttccagcacctgctgcagcgcatcgaagcccgtgtgaacgacacggactccggcgaattcacctccaagctgttcgtcgctgatggcgtttctgttgaagaggcagctgccgctggcctgctgaaccacgacgacattctcgccgatccggcccccgcactcgaaaagctcgcactggcctacccgcagaccgccgaacttaaggtggttccggccgacgtggcttggttcccggtgctcgtgcgcgaataccccaagcccatgccgttcgtgcccgtcatcgacaacgacctgctgcgttggtggggtcaggaccagctctggcagtccgaagaccagcgctactccgccgattccgtgcgtgccatccccggcccgatctccgtggccggcatcaccaccatcgacgagccgatcgccgacatcctcggccgcttcgaaaccgccgccatcaagcgcgtgcaggacgaacagcaggccgccgatgccgctgagaacgacgatttcgccgcactcggcgaggccaccagcgccgaggacttcatccgcaagtccccgaacatctcctgggtcggccacatcaccgacaaccccgcctacggcaccgccctgggcgaccagtactacgagatccgcgcgtttgacgccgcggccggcaagtacgatctggacatccacctcgacacctactgggacaacgacccggacggcggcacctccaagcacgccgtgcgcgatatcgtcatcccgctcatcgtggaaggcaccgagcccggccgtgtgccggtcgtggaccgcgaacgcctgattccggacgtctacgcgatgctcgccgccaccgcaggcatcggcaacaccgccatcaccggcgacaagctcaccgagatgccgcagcttgacggcaagacctctgacgagcgtccgtttgctaccgccaccgccgcctacaccctctccgccaacctcggcttcgaccacgaagcggccaccggcgccgctctgccgacgaccctgcagcccagccgcatcgctcccgatgcgctggtcggcccggcctggccggcgatttacacggcgctcggctccgtgtacgtcaagggctacccggtgattgaaggcctgctcaacgccgtccacctcgaccacctcatcgaacttgaggtgaacgaggaggacctgcttaagcacaccggtgaaaccatcaccctgaagtcttgggctgaggattacttcgagtccgcctccggccgcgtggtcaccatccacgtgacccacaccgctgccgacggcacgctgcttgcccgcgaaaccgagcgtttcgcgatccgcggccgcgtctactccgatgctttgccggcagacgcccccgagttcggcgacgccgagcacgaggagatcgcgcccacgccgcgccgtctgctgcgccgcgtgaaggtcgtcgccccacacgacatgaccgccttcgcccgcacttccggcgacttcaacccgatccacacctccactcgtggcgctcgcatctccggtttggccgctccgcttgtgcacggcatgtggctgtccgccaccgcccagcacgccgtgcaggcgctggacgagaaggatgcccactacgagattgccggctggacctacaacatgtacggcatggttcagcttgacgacaccgtcgaaatctccgtcgagcgcgtcggcaaggtgcgccacggcggcatgaccctcgaagtcacctgccgtatcgacggccagctcgtctcccgcggcaccgcactggtccgcgcaccgcgcgccgccttcgtctaccccggccagggcatccagaagcagggcatggttctggacgagcgtgccaagtccgccgccgcccgcgacgtgtgggagcgcgccgacaagctcacccgctccaagctcggcttctcgatcctgggcctcgtgcgcgataacccgaaggagctcaccgccaacggcgtgacctaccgtcaccccgaaggcctgctcaacctgacgcagttcacgcaggtggcgctcgcgacggttgcttttgcccagaccgcccgtctgcgcgaagccggcgccgatatctggcctgcatacttcgctggccactcgctcggcgaatacaacgcgttgtccgcgttcgccgacgtgattccgctggaaaccgtgctggagctcgtgttccaccgtggttccaccatgcaccacctcatcgagcgtgacgcacagggtcgctccaactaccgcatgggtgccctgcgcccgaaccagttcggtgtggacgacgcgcacgtcaaggaatacgtggaatccgtggccaaggcgtccggcgaattcctggagatcgtgaactacaacctcgccggccagcagtacgccatcgccggtacgatcgccggactcaaggctctgaaggccgattccgcccgccgcgtggccgcattcggtggcaagcccgcgttcatgctggtgcccggcatcgatgtgccgttccactccacactgctgcgcaagggcgtgccggaattccgcgacaagctcgacgcgctgcttcccgcttacatcgactaccgtggccgtctggtggaccgctacatcccgaacctggtggccaccccgttcgagatgaccaaggaattcgccgccaagatcctcgaagtcgtgccgtccgagcgtatcaaggccgcgctcgacgacccggccgtgtgggattcctacgccgatgacgaccagaagctcggccgtctgctcttgaccgaactgctctcctggcagttcgcctccccggtgcgttggattgaaacccaggcgctgctcttcggtcagcgcgaacagggcggcctcggcgtggaagaatacgtcgaagtcggcctcggcaacgccccgaccctggccaacctcggtgccaagaccctgcatctgcccgagttcgccggcaacgatacggtcgtctacaacgtcggccgcgatgaaggccgcgtctacatgaccgacaccgattcgctggttcccgacgatgagccggaagaggctgcggcctcggccccggtcgaaaccgctcctgccggtggttccgccgttgccaagctcggttccggtgccgctccggcaaatgccgtgactgaggctgctcagacaacggatggctccgtcgccggacagtccactggactgtccgactcctcgcgcggcctgcaatcagggcaggccgcggctggcgcaccgtccggtgccgccgtcgccgacctgcccttcaaggcttccgatgccatcggcgtgctcatggcctactccgccaaggtgcgtctcgaccagatcggcagcaacgacaccaccgacaccctgaccaacggtgtctcttctcgccgcaaccagctgctcatggacatcagctccgagctgggagtcgccagcgtggacggtgctgctgaagcgacgctcgacaagctcgcccaaatcgtcaacaaggccgccccgaactacaagccgttcggtgccgtgctctccgaggcgctgcgcgaccgcctgcgctcgctgttcggtgccgccggcgtcaagcagcagtacatccgcgaccgcgtgaccaacgtatggcagctcggtgaaggttgggtggccagcgtgctcgccacactgctgctcgacactcgcgagggtgccagctcccgtggcggcgacctggctaagctgcccaccgccgccgtgcagaacaagccggaagccgacaagctgattgatgcggccgttgaggtcgtcgcccagctcaagggtgttgccgtggccctgccgtccgccggtggtgccgctggtggcgctgtggtcgattccgccgcgctcgacgccttcgccgagaaggtcaccggttccaacggcgtgctcgccgccaccgcccgcttcgtgctgaacgagctcggcgtggccgctccggctccggaagaatccgaggacgagaacgccgccgtcgtggccgcggttgaagccgaacttggctccgactggcccaagcaggtcgctccgcgcttcgacgccaacaaggccatcctcttcgatgatcggtgggcttccgcccgcgaagacctcgcccgcgcctactacgacaacgatcccgccgccctgaacggcagcttcatcggccttggcaagaccatcgccgccgaagcccagtggttcgccaacgagtcggagagtgaagaactcaaggccgccttccagaaggccggctccgaggccctcgaacaggttgcgtccaacaagaacgcctcccgttacgcgaatgatatcgccatcgtcaccggcgtgagcccgaactcgattgccgctcaggtggtcgaaggcctgctcgcaggcggtgccactgtggtggccacctcgcacagcttcaagccgtccattaaggcttgggctaagcaggcctaccgcgagcacgctaccggcaacgccaagctgtggctggttccggccaacctctccagctaccgcgacgtcgacgcactggtcgactgggtgggccacgagcagaagaagacctccggtgctaccaccacgattctgaagcctgcgtgggagccgaccctgttcttcccgttcgccgctccgccggtccatggcacgctcgccgactccggcgacctgttcgaatcgcaggcccgactgatgctgtggggcgtggaacgcgccatcgccggcttcagccacatcggtgccgacaccaacgtgcagcacaagctccacgtggtgctgcccggttccccgaaccgcggcgtattcggcggcgacggtgcctacggcgaagtcaagagcgcctttgacgccatcgtcaaccgtgcccgcgctgaaaaggtgtggtcgagccgcgtcaccttcgctcacccgaagatcggctgggtgcgtggcaccggcctgatgggcggtaacgacccgctggtcgccgtcgttgagcgtcacggcatccgcacctactccaccgcacagattgcggccaagctgctcgacctgtgcactgccgaatcgcgcgagcaggccctcaagaccccgctcgatgtggacctgaccggtggcctcggttccgagcccatcgacatcaaggccctgcgtgcggaggccatggccgacgccgagaaggaagctgctgcggcctcgtctcaggaaacggatggctccgtcgccggaaagtccactggactgtccgactcctcgcgtgggcagcaaatcaaggcgctgcccaccccgatcgtcaccaagcaggcttcggtcgacctcaacgactggaccaacgtcaccgccaagccggaagacgaaatcgtcatcgtttccgtcggtgagctgggcccgtggggctccggtcgtacgcgcgcccaggccgagctcggcatccactcggacggcaccgtcgacctgagcgccggagcagtgctcgaacttgcgtggaacatgggtctgctgacttgggccgacagcccgaagcccggctggtacgacaccgacggcaacctcgtgcccgaagaggacatcgccgagcgctaccacgacgaggtcgtggcccgctccggcatccgcccgttcgaggaaggcatgggcaacgactacaaggacggtgctgacgaagaggaagccgaggtcttcctcgaccacgacgtcaccttctctgtgcccacccgcgaagtcgccgccgaatacgtcaagttggacgaggctcacaccaccatcgccccggatgaggaatccggcgaatggaacgtgacccgccacgccggctcgatgatccgcgtgccgcgccgcgccaccatgacccgcacagtcggcggccagttcccgaagggcttcgacccgacccgatggggcattcccgcctcgatggtcggcgacgtcgacaagatcgccctgtggaacatcgtcaccactgtggacgcctacctgggcgccggcttcaccccgaccgaaatcctcgagtccatccacccctcgctggtggcttcgacccagggcaccggcttcggtggcatgatgtcgatgcgcaagctgtacctcgaccgcttcctcaaccacgagatcccgaccgacatcctgcaggaagccctgccgaacgtggtcgcggctcacgtgatgcagtcctacatcggcggctacggcaacatgattcagccggtctccgcctgcgccaccgcagccgtctcccttgaagagggcgtcgacaagatcgccctcggcaaggccgacttcgtggtcaccggtgcgatcgacgacatcggcgtggaatccgtgatcggtttcggcaacatgaacgccaccgccaactcggaggaaatgtatggcaagggtatcgacgcgcgcttcttcagccgcgcgaacgatcgtcgccgtggcggcttcctggaatcccagggcggcggcacgatcctcgtgacccgcggtgacatcgccgaaaagctcggcctgccggttgcggccgtggtcggcttcatccactcctacgcggatggtgctcacacctcgatcccggctccgggcctcggtgccctggctgccggcctcggtggcaaggactccaagctcgtgcacgacctggctaagctcggcgtctcagccgacgacatcgccgtggtctccaagcacgacacgtccaccaacgccaacgacccgaacgaatccgagctgcacaacacgctggcccacgccatcggccgcaccgacggcaacccgctgttcgtgatctcgcagaagacgcttaccggccacgccaagggtggtgcctgcatcttccaggtcaacggtctgacgcagctgttcaagtccggcgtgattccggcgaacgcggcgctcgactgcgtggatccgaagctccagcgcgacgaccacatggtctgggttaggaagcccctgcgcatcggcggtggtgaggacgagttcggtcgcgagaccgctggtcgcccggtcaaggccggtctggccacctcgctcggcttcggacatgtttccggcttcgtggctctggtccatccgggtgccttcgaggcggccgtggccaaggccgatggtgaggccgcactggaagcttggcgtgagcgtgccaacgcccgcctggctgccggccagcgtcaccttgaggaaggcatgatgggtcgcgccgcgctctacgagccgatcgacaaccgtcgcttccgcgaggatcaccgtggctacgaccaccacgaggtcgaaaaggctatgctcctcaacccggacgcccgcctcggtgccgacggctactacgaggcctgattcctctggctccccccggttgatgggagccagtagcgcaccggatctcggctcccctctttgaggggagctcccgcgaagcgggtgaggggagtttcccctggagctttctcgctggcacaaactcagtgagagaaatatgcagaacatacgaaagcccctccctcggagtgggctttctgcgtttcaaggggctgatttggcattcgccggaggtctacttccgtttcaaggggctgttacccaagtagacaaggcgtaaaaacggcggaatggcgttggcgttatgctgcggatactcgtggtatggaggatgaccagccccttgaaacggaagtagacctccggaacggtcaaaatccgcccctcgaaacggagatagaccttcggggcggggcgcggatgtttttttggacggctaggcagccagcccaagatgtttgcggtattgcgcgaggtcatccagcatagtgaatcttttccccctgaaatggaaatcaggccccaattctgatgaggtgtagagattacgcgcgaagcggtacacaataggaagcatgaatacttgtggtttggggcatgacgtggtggatgtggccgcattcgccgaacagttggcggagccggggtctcgcatgcgtgcgctgttctccgtgcgtgaggtgcggcaggcatccgaccgcgcgcgccagaagaatgacggggaggccgtccatctggccgccaaatgggcgggcaaggaggcgttcctcaaagcctggtgcgattatcttggcgatgccccctatccgttcacgcttgataatttcccgtggcctgaaatcgagatcttggacgattcccgtggtgtgccgcatgtgtctctgggtaagggggcggcgtcagtcttccaaactgattacgcgaattcggctgccggcgctcgctattcctctgcttattcctctgcttccgataacgggccttatgcagtgatgcaggagcggcggaatgcgcgttcggcgcagcgctcgactatcggtgcggggtcgatgccgcatatccatatttccctgagccacgatggttcgattgcctccgcggtggtgacgatttctgtggaatagcgcccgaggcccccgagtgctacatgctgtacaacgtctccatcatggttaacctgtggggcgcgctcaccagccgcgacgtgcgcctgctcaagaaccagatcgacaagctcgactcgctgcccgaaaactgctggttcgtgattctgaatgcgatgggcgccgacctccaaccatacgagtcccagctcatccatttgtgatttcgacggtttccagctcccctctttgaggggagctgtcgccgtaggcgactgaggggagtcctcggcaaagccgcaatccatcaactagatttgctggtcctgctgcagccacacgcgtttgccatccccgaagaaatatgtataataactcaagtcgccaaaagcgacgcttaacgcggatgtagctcaatggtagagcctcagtcttccaaactgattacgcgggttcgattcccgtcatccgctccactatataggtttgtggctagggtactacccacaacattgcccgtaacaccaccgcccgcaacagaacacggccttggtgagtcgtatgtttgcgttcacggaaattgcatgcagtatgtctccgtgtatgcgtagcggtatgtgatactgcacacatgcggagcagtggcatactgacggtcgtcagtaactccggcccccgcgcagcggcggcaaatccgcctcagttcccagatggtgggaccggcacgccccgtcgagaagaaaagtgcgttatcgcagggtggatgacgagggtgccacttttcaaaaattccaaggttcttttcagtgtcgggtaaaaaattccctctacccgggtgtacgcattcgtgctttttgcttaataccgtaacgccttataagcgtaacgccgggttttggcgtacgtgatcgtaagagacaggcaaggttatgaagagaattgcagaatggttcgcagcggtaggggccgcggcgggcaggaaaggcaaacggttagtggcgatcgttgccgccgtggcgatgctcggtggcgtcgccggtgtgagcgcgaccgccatggcggacgatgggaatgcctccacgacacaatcgcagaccaccgatgagaaggtggccgccagcgcgcctgctcctctttccaccgagggaacaaacggcgtgccggatgatccgacgttgtctgctccggcccgcgagaagaccgttaccgccaatgaagacggcacgtacacggtggcgttgaacgtcaccggtgcgaagagcgcgggtacgggcgagatcgtgacgaaccagccactcgacatcgtgctggtgttggatgtgtccggttcgatggccgaaaagatcgctagcggttggaaccagcctacgaagattgactcgctcaagaccgcggtcaataaattcatcaatgcgacggctgcagagaacgcgaagattaccgaccagagccagcggaaccgcatcgccctggtgaagttcgccggcaccgagaagaccagcgtcggcaatgacttttaccgcgaaggctggtcctcctacaactacacgcagatcgtcagcaacctgacgtacgacgtctccggactgacgagcacggttaacggcctgagcgcgtccggcgcgacctccgccgactacgccttcaaccgcgcccaggcggcgctaacgtatcagcctcgcgccaacgcgaagaaggtcgtcatcttcttcaccgacggcgagccgaaccacggcagcgggtttgaccccaccgtcgccgccaccgcggtgaacaaggcgaagagcctgaaggacgccgggacgaccatctactcgatcggcgtcgtcagcggtgccaaccccggcgacacctcgagcaacctgaacaagtacatgcacggcatctccagcaactacccggatgccactgcaacgagcagtgagcatttgtggggaaagtcttggaacgccaacctcggtgaccgcgccgagaccagcagctactacaaggccgccacggatgccggccagctgaacaacatcttcgagtccatttatcaggagatcaccaagacggctgagtatgccgacgtgacgattcacgacaggctgtccagctgggtcgtgagctccgacagcgcctccgagaatggagagcccgcgggcttcacgtacacgaagacccggaacggccagatcacggcgtgggatgacgccccggaggcgacggttgcggctgatggcaccgtgtcttggccggtcatgtccaacggcggcaagcttgaggacggcgtcacctacacggtgagcttcaatgtcaagccgacgcaggctgcgttcgacgaggctgttaagaaccacaaggacgatgccaatgcctccggcgacaacaacttctacacgaacgacaactccagcgccactgtcgactacaagaccgtggtgacctcctcgcagggcggcacgacgacgagcgatccgcagaccgccgcctacccgcagaagccgaccatcacccttccggtctccaagattacggtgacgaagacttggtccgacgacaacgagaatcacgcgaatgattccgtgcaggtccagctcaagcaggacggcgaggattatgccaacggttcagcaactctgaatgccgccggcaactggactcacgagttcacggtgcctgccggccctgaggggcacacatactcggtttccgaggtcaaggttgaaggctatgactccaaggttgataagactgacctcaagctacaaggtttgaccgcacaatccggtgccttcacggtaaccaacacgccttcttacgtgaccttgcccgcttcggatgtcaaggtgacgaaggttgtgcagggacatgctgctaattcggacttcggcttcaacctgaagtgcgtggatagcacggatgcgaatgctggtaagtgcgctgacgttaccggcttggccaacaatggactgactacgactgtgtccaaggacgaattgactgctagcggcgcgagcgcgacggttggcttcggcaatggggacctgaagttcagggttccgaccggtgctgacaatttggtctacacgttcgaggcttcggaggacaccgaaaagcctgctgccggttggaagtatgacaacgataaggtgaccgtcaaggtcacggtctccaggacggatgccgttgtctcttacgagtacggcgagaacgattccgaccgaacgaatacggagtcggcacagttcacgaacaagtatgtggctatctccagtctgccgctgaccggtggcacgactggtcgtgactggatggtgttcggcggtggcctgggcctgctggccctgctggctgctgcgggctacacggtctggcgtaagcgtcagctggtctgatttcaagaaacttgaggtggttttggctcctctcgctgaggggagctggccgccgaaggcggactgaggggagtcaatgaaggcttccctccccgaaaaaaacaataaggatttgcggatcgcggaggccccgctgtggggttgcagcctccgcgattgcaagaaaacaatcacaataaggaagagagggtttctcatgaagttgaggaagcttttcgcgggtgccgctgctgcggccaccctgctcggtggcatggccttcggcgccaccaccgccaacgcggctgaggccaacatctccagcacgactatcacagtcaacgccacggatgcaaaccagttctacaccaagccggttgacaccgctgacctgcaggctaacctgcgcatgttcaagtacgttgagctcgccaagtatgtgtctgatggcaacactggcgttgagctggagggtttggtctccggtgaggcagtggatgctgctttcgctgctgctggttacaacgaccagaccaagggtgattccctgaacgagtgggcctggctgggcaacactaccctgaccgccgcgcagaccaccgcttttgtgaacgcgcttaaggatctggctgtcacggacattaccccgacggcttctaacggtggcaagacccagaccttcaccttcgctgagggtggtctgtacttgattgtcgaccagagtggaaagctggtcgtcgaagataatgacactcacaagctcgtgtggaatggcaatgctccgattctcgctggcactgctatcacgggcgccgcgccgtccgtgaacaacgccactggcgttctcgccgctgccggcgttgtcgacctgaagagcagcaaggaagaaaccaccaaggctggtgccgtgacttggcggaaagtcgacaagaacgctgctgctctgactggtgctgagttccaagtgtacgaaggcgatgttagcggtctgtccgctgacgagctcaaagcgaagactccgcttaagttcaatggctctaacggtgcgtattctctgccgaccgccaatgctgatggcacttaccctgaaggcgccacggacacactgcaatccaacgctgagggtaagtacactctgaacggtcttaagctcaacaccacctacaccgtgattgagacgaaggtcccgactggctacaacggcaccttcgttggcaagttcacgatcactaccggtgcaaccgcagatgctgctgccaccttcgctggtaaggatgcctggaacctgtccaaggacaacaagggcaccttccaggtcaccaacgtcaagaacatcacccagctgccgctcaccggtgccgccggaaccatgctgttctccgtgatcggtctgctgatcgcgggtgccgcggtgaccgtgttcgtcaagtcccgttccaccaagcgcgctctcaacgcgtgagcttgactgctgcttatgactgagcagctataacaatggccgatctgattattcagatcggccatttgtcatattggcggcatctcagacggatgacttgtggaccatctccgaatcttatgggcaatgtatggcattttgatttgaatgtaatggggccgggcatcgaaaataacttgtgtttcaccacaacaaacgtttcacgcaggctcggtaacaatcgccaagcgaacacaatcgtaggggaggtgaaggatgggcctgtataccccattcgtgggccgattatcgttcagttgccgtccagccactactcaggctccacttaaacggggataaaaacgaccctactaggggttaggcatgtccgaattataagtattactatcccgaactatggcattcaccccataatcaaggggggtgtgcaatgagccttccaacgagtgtaagggatgaggatgaccagtggtggagggacttttagccccgaggagatcaagtatctgaagtcgttgtcggcagtggcggaagccacggcgaagcgcatcacctataccgatgatttcaagcgttactgtgtagtccactacaacgaaggtgcctcacccgtgcgcatgttccgtgaagccggattggatccggctctaatcgggtacaagcgcatcgaacgttgccttgcccgctggcgtgaatcgcaagacgaaatcctgaactccggcaatgccaaagccggcgtggaaaataagctgggggggggggcttcagattcggagcttttccgctcgggagccgcgggcgcaccaaacattccggagagtgcgcgagcagcgagagcttggcgcgactcggcggaatcgtcacttccggctggtaccggcagcgaatccgatttccacgtatcgcccgaacgtcgcgccatcatcttccccgtctcccgcaaagagcagaacaatgacctacgcgacttgctgatttcgcagcaggtacgtcgtatcgacgaactggagcgtcaggtcgacatgctcgaggccctgctgcacggcaggcggcgtaaggaacaggctgccaatacgttgcctgaggaacagacggatacagcggcggacaagtcgccggatgcagacgggcagtagcagtagcctgtctgtatccaatcagcgcgcgaaaccgcagggagcatcaggtacttgcccaacacgcacgctaagataggcatcgcaataatcggcatggcaatacatggcaatgagcaggtaatcggcgaggcggtgcatggagcaggaacccaacgagcaagaacctaacgaggcgacggaaatcgtaggcggcaaagtagagaccgtcgaggtttccaggcaccccgaggcttccatacccgagaccgatttgtctttggctgatatcgagcgccgtcgctcccatccgttgcgttgggcgttgattattcttgccgtactgtgcgccatcatcgcgccatactggttcggtcgctcgctggcggtgaataatactgactccattgtggccgtgctcgggggagtgtctccgcaaggtatcgcactggtcggttgggtggccgtggtgatcacgtacgtcggattggcgatggcggtggtcgtctcgccgtcctggccatggctgatcgtgttcgtgctcgggctggcctgtgagcagttcatcgcgggactcagcatgctcaatctcaacttctggtattccacgtacgtggtctacggcaagcaggccggtctggcaaatgccgcgaatctgggcattatgggggcggcgatcggcatcgccgtatacgccctggtgtttgttggtctgctggtgattatccggaagacctcgccgctgaacgtactgaccaaaagctgggcgagtttcattctgtacttcgtgattgaaaccatcgccctgctcgtggtgttgttcggcggattgctcaccactgtgtgagcgcacgtgagtcgccgtacgtcgctcaatactcaccactcactgctcaccgccgcgcaaaccgtgtgcccgatgtctatttagaggtgcaacaccccctgttggtcctgcaattatagcagttcgtcggcgaatgcctcggcggcccggattcaatttgtaagcgcaacgcttgtgttcgggctggctgccttcgattgtgttttctaggcaatttccaatctaacgggtgttgcactttcatttagacaacgggaaatgtgtaacgcttacacgtttatgatatgataaatgtgtaagcgtcgcacatttatcataggatatccgtcatgaagctccagcgaaaagcactgaaaacgctcaagcagtggaagaccacacctgaccataagcctctcctgatccgtggcgcacggcagacaggcaagacatggcttgtcaacgagttcgcgaatggacaatacgacaacatcgtctcggttgatttcatgcagcggccatccctatccgggatattcgagcaggatcttgacccgcaacgaataatccgtcagctcgaactcgccgccaaccaacggatactccccggcagaacactgctcttctttgacgagatacaggaaagtccgctcgcgttgacctctctcaaatacttcaccgagcaggcacccgactatgacatcatcgccaccggctcctacatgggaatatccaagcacggcaaaacctcttttcctgtaggaaaagtcaccatgatgaacctacatccgctctccttcgtcgaatatctggacagcatcggacaagacatgatcgccgacaccatacgtgaaggccggttcgaggacattccacaagctctcgaacctcagatgaatgacctactcaaaacatatatgtgggtcggcggcatgccagcagcattaagcgctcacctggataacgggattccgcaggatgtgcgagctgtccaacaagatattctcaacgcctacgatcttgatttttccaagcatgccgcatatacgctgggcgagcgtatccggcttgtatggaacacactgccatcacaacttgccaaggagaatcgcaaattcgtttacggtgttgtcaggcaaggagcccgcgcccgcgaatatgaggaagcgctcacttggctgacggactacggaatcattaccaaagtcccctgcctcgatgctctgcatattcctctgaccggatatgagagtcttaacacgttcaagatctatctggaagacacgggcatactgggcgcactgtccggtctcgacgtgaatactctggtgaacaagtcgaagctcttttccgaattcaagggcgcgttcgtagaacaatacgtatgtcagcagctggtagctcaaggaatcaaaccccgctattgggctaacccaaatcctcaaggaaatgcggaaatagatttcgtaatggaacagggagacgaggtttttcccatcgaagtgaaatcctcttccaatattcgtgcgagaagtctctcgtatgtctgcaacagatacgggctccacggtatccgtataggagaaataggctataggaagcaatcttggctgacgaacatcccactttggtgcgtggatgggctgggcgaatatctcaaacgtcaaatcgaaaagagcagggccgaagcgtaatcgttcacccgcacgcggccgcggtgacgcgggtcatgaaacggtcgaggaattccggcacgttgacgcccaatgcgacttgggtgtgtttgtcgggatcctggagccgtgaacgatcgccgatggtacggcctcggaacgggccctcgagatcgacttgcaagttgaacccgaaggtcgtgaccagcgatgggtcgagcgcggcggccacggccagcgggtcgtgcagtccacatccgtgaatctccggctggttcttcaggtagaagtcgatgtagtagtcggtcatggtgacgaggaagtcgccggccggcgtccccaaagacgcccattcatgggctttctcacgggtgagcgcggtctggtgggtcacgtcgaggccgatcatggtggtgcttgcgccgcacttgaacagatagtctgctgcctctgggtcttgggagatgttcgcttcggcagccgggctcacattgccgggcagcgtcaacgcaccgcccatcaacgtcacgttcacaccggaatccttcaagtccggagcgttgcggaatacggtggccatggtggtcatcgcgcccgtaggtacgatggtcaggtccgggccgtattcgcgcgcggcggtgatgatgaaatcgaccgccgagcctggtgcttccggagcgcgcggggagtcggggatgattgcgccgccgatgccgttgggatggtggaccgccaccgagccgggagttggtgaccacgaagcgtccgtttgccagccgtccgcgccgccgttctgccagcgcgcgtaggcctgggcccgctcgtctggtgtggtgccacgcattttcggcaatgttgccggggcgatgggatggtcgactccgggatagaccggaacgtcgtcacggccgaacaagtgcagtaccgccagcgcgttacgcgcggccagcggcaccgcgatattgccgtaggtggccgtgataccgatcaaatcgatctcgtcggcactgcctagggcatatgcgatggcgagcgcgtcatcgatgccggtatcgaggtcgaggatgagtttttgcgcacaattatctccttgtggaactacccgggactactccggcgactacccctcagtctcgctacgcgagacagctcccctgacaaggggagctgagaaagttcagccgagcttggcgagttcttcgggggtgagttcgagctggtcggccttcagggagtcgaggatggtttcgggacggtgcgcgccgggaatcacgaacatgtggtcgcccttggcgagctcccatgccagcacgacctgctggtagctcacgccgtgggccgccgcgacctcgcggaacgggtcgaacttggtctcatcataggggtgacggtagccgccgagcgggctccagcacacgaaggccaagccaaccttggcgcagtagtcgagcgtgtcctgggtctccaggtgaatcggcgagtactggttttgcacggccacgagcttgtcgcccagaatgccgcgcgcaatgtcgatttgctcgatggaggcgttggagataccggcctcctgcgccacgccctcgtccaccagctgcttgatggcttcgacggactcgttgtacggcaccttcggatcggggcggtggaagtacagcaggtcaatggtgtccacgccgagcgccagtgcgctctccttgccgcgacgaatcaggttctccgggcgaccgtccacatcccacgtggggcggccgtcggtgaagttgcggaagtggcccaccttggtggccaccagcacctcgtccttcggccccttccaggtctcaagggcctcgcgcaccagcttttcaccggtctgttcttcgccgccggagcagtagtaggcccaagcggtgtcgatgtgacggcagccggcgtccagcgaggcatgcagggtttcgatgccgacctcgtggccacgattgttttcgatggtcagcggcatttcgccgtggccgatggcggtggtggagaacggtccgaggttacggaacaatgccatggtgattcccttcaacagtaatgagacggtctgtgtccgattccagcgtaagcagaacgctggatttaccgcccaccgaacgagccgccacccgaaccgccgaacgagccaccgaaaccggagccgccacccgagccgaagctggagaaatcgccaccggaatcggcggatggtgctgccgcgctgatggtcgagctgatgtcagcgagtccggagttcagctgcgagccgaggtcggagaatccgccggcaaacgatgtgcctccgtaagccggagctgggccgctaatgcccgggtccatctgcccggcagcatcgtggtcgaacggaccattatggcggtggctgtaccagccatacgggcggtagttccagtagaacaacgagttggaggcgttggcatccagccaagccggatcgttgacctgaggataggccttggccagctcacgcatcacgcgatcggaaatgccaaacgcggcggcgtagaccatataccaatcccacaaggccaaatcggcggcaccacggtcggtgaagttggagaagtcttccatataacgcttaaggcccagagtccggccggcaatatcctggccttggtcggtgagcacggtcatcgcgccggccatcgagcagaacaggccgaccaggaatatcggcagctcgataagaccagccaccgggtatccgataaagctgttggccagcagcgaaccaaatcccagcacggcggccaatacgccgggtaggatccattgccagcccacagagcgcgtggcacccagccgctggtattccatgctgcatgcaccggtgaatttgccgagctcaatatagccgtcttgccaattctggcaggtcgccttcatctggttcaggtcgaataccgggctgcccacgcgctgcgaaatgacgatgagcaggttcagcagcgcatcttccgattcactcaatcccaactgttgcgcgttgggtgcctcatcaatggcgagcggcagaatcacgatggtgctggtgatgcctgccgcatactgcttgccttggtcggcggcaatcatttggctcaagcctaccggcgtggcctggctcatgtcgatgccgcgatacatgtccgacggccccggatagacggcaatggccttcttgacggcgagcgacagcatggtggcggtcagctggcggtcttcatcggattggcgcgtcgacggatcgaccacgcgaatcagacgggctgcggaagccggactgatgccgggctggtcgcgccagtattcgacgctgccacggtattgcgcacgccggttgctggagatcacagcccagataccccacgcgcacaacgcgatgccgagcacgatgctgacaatccaggacacgagacgagctctggcagcgaatcgttgcttgtcgagccagcgctgctgttgcttatattcgtcctgtttcaggtccttgagatgattgccggttcccttgcgggcgatgcccttggctttggcggcatcgaacgccgcgaccacatcgaggtagtcgccattgtggatgttgtaggccgtgaacgtgtagctgccgtcgctgttgcgcttggtttccgaagtgcgctcggtgtgcagccatgcccatgaggttttgccggtgatgccgttggggaagtggacggtgccggtgaccgtgccgataggcacttggttcttcttgccgaacggctcccattggaaggaggccacgtctttccatttggtggccacatcgtgcatggtgaagctcacgtcgaacttcatactgtcggcctcggtggtgaccggaatattccagccgatctccacggtcatgttatcttcggtggcggaggcgctgggcttgaggccatcggtaccgggcgtgtatgcctttggatggtcgctgccatcgctcacatcggcgatataccaatggttggcgtagtcactgttccattccttgtcggaagagacgtcactgggcagcttgggctcgctctgttgggcatagtcgatgccgtctgtgacgttgcgcacactgatatcgctgatatcagtcagggtgccggagttcagcgtgtattgctgaaacagttgcttccacggcttggtgttgtcgtcactgtcggtacgttcacgcatcttgacgtcgatatgctgcgtgaccttcaaatcaccgttcgcggtggcggtcacatcatagtccagcgtgcggtagctgaggtcggccgaatcgccgaacgcggaagtcccgattatcgccaaggtgataactgccaacaccaccgtggcaacaatgctgacgattccggcgcgaatgaatcgtatccgcatgtcttccctctcttaaggcaatacgggcccggccggcggcataccggacgggcctggagcgggtcagaactggacctgtggcacctgacgggaggcatcatcggcctcgaagtattgcgcctgttcaaagtggaacaaaccggcgatgatgttcgtcggcacggtttcgatggcggtgttgagcttcaggaccacgtcgttgtagaactgacgggcgtaggcgatcttgttctccagttccttgagctggttctgcagatccatgaagttctggttggcttgcagctgcggatatgcctcagccgtggcttgcaggttgaacagggcgcgggacagctggttttcagcggcggcgcgctgagcagtggtcgtgctcgggttgctggccgcagccactacgccggcgcgggcggcggtcacctgagtgaagacttcagactcgtgggatgcgtaccccttgacggtattcaccaggttcgggatgaggtcggcgcgctgcttcaactgcacgtcgatttgcgcccaaccgttcttcacacggttcttcagcgtcaccaggttgttataggcgctgacgccccaaccaatcaagacaacgataataacgacaacgacgatgctgacgatcagaccagtactcacctatgctcctttgctggacctcgctgcgaccattcttccatactcgcacgttaacagaaaatttatcacggagtgttcatcgtgcggacttgtcttgtaccgctttaccgccgttctcccgtcgatcgaccgaagcgggaaatcgccgcccagtctgacgaagtattccagctcgctccgttacgagaacggtaatactcggcaatactcgcgctgaatatgcgaaagcccgccttgcgacgggctttgccgtttctcctacgcacaaatcattacgctgcgcgcaggaaacgatcagccgaaccttccagagatgtagcgctcggcttcttcgttttgcgggttgttgaacatcgtcatggtgtccgcgaagtactcgaggtgaccgggctggcccacggccttcaggttgaagaaggcggtgtagtcggcgatacgggcagcctgctgcatgttgtgggtcacgatcacgatggtgtagtcgctcttgagctcgtcgatcagatcctcgacagccagggtcgaaatcgggtccaaagcggagcagggctcatccatgagcagcacctgcgggtggacggccacagcgcgggcgatgcacagacgctgctgctggccaccggacaggccgatgccagggttgtcaagacggtccttgacctcttcccagaggttggcaccgcgcagagcccactcgaccagatcgtcggcgtcggacttggccaggtggtggttgttcaggcgcacaccggccagcacgttctcacggatggacatggtcgggaacgggttcggtcgctggaagaccatgccgacgtcgcggcgcacggccaccggatccacgtccttgtcgtacaggttcttgccttcgagcagcacctcgccctcgacgtgagcgccagggatgatctcgtgcatacggtccaaggtgcgcagcacggtggacttgccgcagccggacgggccgatgaaggaggtgaccttgttcggctcgatgttgatattcacatcttccacggccagaaagtcgccgtagtagatgttttcgtggttgacgtcaatacgttgtcccatgatgtttccttatatttccttgtgttcttaaggcttaggcttagcgactggcttagcgttcggtcttgacggcgaagaccttcgccacgattcggccaatgaggttcagcagcagcacgatgacgatcagcacgagagccgcagcccacgcacgttccatcggaatcgtggtcacgcaggtggcgtcggcgttgggcgggcagttcgcgctgagcttcgagtactcctggtagacgaacaccggcagggtggtcatctggccggagaacaggttcacgttggtgctggagatgtagccggcggtcatcagcaacggtgcggtctcaccaatcacgcgggcgatggccagaatggcaccggagacgatgcccggcagagcggtgcgcagcacgatcttggtaatcgtgcgctgcttggtaacgcccagagccaaggaagcctcacgcaaatcgttcggcacgatcttgagcatttcctcgctggacttgaccacggtgggcaacatcagcagggagagagccacggagccttcgaaaccgttgatggtaccggggcccagcagaatcgtgaacatcgagaaggcgaacaggccggccacgatggacgggatgccgctcatcacgtcgacgagcagggagaccgtggtggcgagcttgccgcggttcgagtattcgaccaggtacacggcgcacatcaaaccgatcggaatggagataaccatagcgccagcggtgatttcgagagtaccgatgatggcgtgcagcacaccgccgtaaccaccggacggggtctggttaccaccgaccacaccggtcatgttgtagctcaggaagttcaggttcaggcgcttgatgccgttgacgatagtggtccacagcagggagatcagcgggatgcaggcgatcacaaacgccaccgcgatcaggacccacatgaagtggtccatgatattacggcgctggatggcggaacgggtcgggcggaaacgatcgaagtcgatttcgggcgcgccgtccatcggagtcttttcagtgttctcagcagcagtcatcacgcagtcgctttctcggtaagcttacgggcgatgaagttgaccacgaacgtgatcaggaacagaatcagaccagttccgatcagcgtggagacgcccagatcgttggcttcagggtactgtgcggcaatattcgcggcgatggtctggttctgcgaggcctgcagcagcttgatggagtagttgaggcccggggacaggatcatcaacacggccatcgtctcaccaagcgcgcggccgagagccagcatggaggcggacacgataccggacttgccgaagggcagcacggccagacgaatcatctcccacttggtggcgccgagcgccagcgcggcctcttcgtgcaggcgtggggtctgcatgaagatatcgcgggacatggaggtgataatcggcaaaatcataacggcgagcaccacagccacggtggcgacggtgcgcggcgggttggcggccgggccctcgaacagtggaatgaagcccaggtggttggcaacccagttccagaacgggtagatggccggcaccagaatcaggccgccccacaaaccgtagataacggacgggatggcagccagcaaatcgaccacatagctcagcgcggtggcgagcttcttaggcgcataatgcgaaatgaacagcgcaatgccgatggacacgaagaaggcaatcagcagtgccagcaaagacacgagcacagtaccgaacaacagcgggagcacgtagccccagaagctgctggccttgccgccggtaaagctggacacggtctggctgttggcggcctgatcgccaccgatgagtggccaggcgcggaagaacaggaacaggaacacagcggcaagtacaaccaggatcaggatgccgcaggcgtatgccacaccgcgaaacaccttgtcggcggtcttgccaccaactggctgcacagccgttttgtcttgcgaactcacggattctccttatatagggtggttatcaagtattcaagtggtgcggttttcgtctgtgacgttgccaaaccgttcgggtcctgacccgctttaagccgcagccgtatggtttacgactgcggcttaaagttggcggcgactgctcttactactacagtctatcgttcagttgtcaggtccagtccacacgacccttgcgggccgacgtcatcacttggtcttgatggcctcgatggacttggtgatctcggacttcagggaggagggcagcggagcggtgccggcggcatcctgagcggccttctggccctcgtcggaggtcacgtaggtcagccaagccttggcgaactcagcctgcttggtgtccttgtaggccgggcagacgatgtcgtaggagaccaggacaatcgggtaagcgccctcggcctcggtggcgtggttgatcttgatgacgatgcggttgtcacccttaacggtgtcgtcctgcttggaatccccaatgaccttggagccggcctcggcggaaatctcgttgtacttgtcgccgaccttgacggccacggtgcccaggtcgccgacctgagagaagtcagcgtagccgatggtgccgtcggcctgcttgacggtggagatcacgccagaagtgcccttggcaccctggccaacctcgttcggccagttctcggagaggtcgtaggtccagttgtcaggggtgacgtccttgaagtaggagacgaagttctgggtggtgccggacttatcggagcggtgcaccacggtgatggcggtgtcgggcagcttcaggtccttgttctgatcggcgatggccggatcgttccacttggtgatcttgccgtcgaagatcttggcgatggtggcagcgtccatgttgatgtgcttgccggcatcggaaacgcccttgaggttgaaaaccacggcgatcggggagatgtagaccgggacatcgaaggcggtgccttcagtgcacacggacttggactgctcaacttcgtcatcggcaagggccttgtcggagccggcccaagcggtggcaccggtcaggaaggtctgcacgccagcgccggaaccggacgggttgtaggcgatcttggcctcagggttggtgccctggaagccggcgatccaagcttcaacagcggcctgctgagaggaggcgccggcgcccgagaagttgccggagatcggggtggacttggaagtggaatcggaggaggagctgttgtcggtcgtggtggcggtgttatcgccgcaggcggccacggaagcgagcatcacaatgccggacagagcggcaatggagcgaacgaggatgttcttctgcatgattattacttaatccctctatcaactattcgcgggcggctcagcgctgcccggtcaattcatgacaactacaagcgtattggtggtttcaagggcccaaaaccgaaatcagtaaacagaagatgaacacttggatgtttgtgggctacgttgaggctacgtagtttttggagcgggctcgcctgcggcgagtccacagcgagcccacaatccacaacaaaaaaaggcgacccgaaggccgccttccatttactccgcgggagtatcgatcttgtatccgagaccgcgcacggtagtcagatacttggggtgcgccggatcttcctcgatcttggagcgcacgcgcttgacatgcacgtcgagcgtcttggtgtcgcccacataatccgaaccccagatgcggtcgatcagctggtgacgcgtcatcacacggcccttgttctgcatgaggtattcgagcagttcgaattccttgagcgggaagaacacggtttcgccgcgtacggtgacctgatgctggccaacctgcatggcgatatcgccacacaccagcggaatatcgtcatccacagtgccggaagcctgggcagtggcctgattgcgacgcatcacggcacgaatacgtgccagcagctcacggaaagagtacggcttggtcacataatcgtccgcaccaatctcaaggccaacgaccttatcgatttcggcgctcttggcggtgagcataataatcggcacacggctctgctcacgaatgcggcggcacagtgcagtgccgtcaatgcccggcagcatcaaatcaagcagcaccaaatcgatgccgcccttggtgaacagttccagaccttcctcgccagtggcggcggcggacacgtcgtacccctcgcgtgtgagctggtataccagcggctcgcgataggattcctcgtcttcgacgataagaatgcgtgtcatagtagcctttcttgggtatgttcccgtgcgcataggcgcaaagttttccgacattatcgtaaccatttgttctccgttagcctgctgtttcccgaaagtacgtaattgcgtaattgggctacgcgcggtgtgcgcacctcgcccactgtgtgattgtgtggcaatggaatggcaccatgtcgggcaccaaccaaggccctacgcttgtgtcgactcgtccgaccgggcctcgtcgtcatcctcatccggggcggccggcagctcgatggtgaacgtcgacccctcccccgtacgcgaccagaccgaaatccgaccgccgttctcctgcacgcagtgcttggtgatggccaagccgagtcccgaaccgccggtctcgcgcgaacgggccgggtcgacccggtagaatcgctcgaaaatgcggtccagcgatttggcggggatgccgatgccctgatcgaccacgcgaatggtgactttgccatcgcgctcccccacgccgaccgccacagtggtgtgttcgggcgagtaatggatggcgttctctacgaggttcttgacggcggtttgcatggcctctttgtcggccttgatcatcggaccgttcgtggctgggctgcctgattcttccaaggaaccttcgccatcggccggctcctcgaccttcgtgggtactgactgtccgttgacactcagtcggatatccacatggcgggagtcggcttgggtctgattggcggcgatggcggcgcgtgccacatccagcgcggaaatgcgccgcgcatcgatcacgctttgcgggctttgggctttctgcaagtcgataagatgatgcaccagttcggtcaggcgcgcggattccttggagatacggccggaaaaataccgtacggcgtccggatcatcggcggcgtcggtcacggtttcggccagtagcgcgatggcaccggccggagtcttgagttcgtgcgaaacgttggtcacaaagtcacggcggacggcctcgaaacggcgctgctcggacatgtcgttgatgaagatggcgtacaggtcatcgccgatatcgccaatgcgcacacgcaaatacagcgtgttggacgggcgtgactggccggcctccagtcctcggccattagaggacggataggaattgcgattgaccggcagctgaacctcacgctcacgcatgccaccgtcggcggcggcctgagtgaggatgtcctcgacttcacgcgagttgagtcggtcgccggagactaggccgaatggcactgagccggggcttgaatattggaccagaccgttgcggtcggtgacgatcagggcttcgggcaggacttcaatcaggcgacgctcggtggggcgcacgggcgcatcatcaccgaatagagaatgcgtatcctcgtcgccggacaggtcctgttcggcggcgagccggcctgaaacgcggcctttgttgtaggcgatgacggcaacccacaccagtatcagcgcggcgagcaccacaatcacgacgatctgccagatatccatgatttccagagtaaaacgtgcgaggcgtagtgagatgcctaaactacgtaagttcgtctattgttcatttttggcgggacgacataacaaaatgctcccgctggcgggagcataatatggggagctctatttacagctcgtagtccttgtccttgctttccttgatcaggaacagagcgagcagagcgagggcagtcatgatggccatgtaccagcccacaccggcaacgccgaacttggaggtgaccagttacaggcgcttgacgatgtcgacagccagacgggcggcggtatcggcgtattcggagatgtcgaactccttgaatacctcgtaatcggtgtcggcgttgtcagaaagggcacgaatcaccagtgccggcacgttattgcgggcggcgacctgtgccacggcggcgccttccatctccacggcgtcagccccggtgagtcggatgacctcctcgaccttttggggcgtgtccacgaagtagttgccggaggcgatgatgccggtgatgtgggtaatgcccgcattggcaagcgcctcgtcggcgacttccagcagacggtcatcagagtggaattcctccaccggagcgtccgcagtgccgggcttccactggcctacgagccgcatgtcagtgtcgaggtagcgcagggtgccgccgagcaccacgtcgttgatgtgcaggtgggtgttgaggttgccggcgatgccgctgaaaatcacggcgtccggggcaatctcgtcaatcagcagctgcgtggtggcggccgcattgaccagtcccatgccgcctaccgttgcggcaaccttgatgacgtcagaaccgaaggagtcgaccgtgccggacacgatgtcaaggctgcccttggcggtgtgcgtcacatgcgtgagcgatttggcgatcagcgccacttcctcatccaatgcgccaataatagctacagttttcatacccatacgtaagttcctttcacaacactttcggctccccttgtcaggggaggtggccgccgaatggcaggctgaggggtagagacgtttcgttgcattgctcccgcgagagagccgatgacgcaactcagtgccaacgccgtgtggctatggcttccgcaagctcgcgcagcaaggcctcggtttcttcccagctgatgcacttgtcagtaatcgacttgccatagaccagctgatcaagcggcgcggccttctgattgcctccttcaataaagctttccatcatgatgccggtaataccctgttcgccagctgcaattctgctggcaatattgcgcacgacttcggcctgacgatgttcgtccttgccggagttaccgtgcgagcaatcaacaatcagaccatgcgaggctgcggattcggcgggcatttcggcgcgtacgtcttccatggctttggccacggattcggcatcgtagttcgggccgtgaatcgagccgcgcaacaccacatggcagtccgggttgccaagggtctcgactgcgcaggcacgccccagatggtcaatgccgaagaacgtgtgctgctgagcagcggcgaagcaaccgttgaccgctgccttcaccgagccgtcagtggcattcttaaagccgaccggcatggaaagcccgctggccaattggcggtggatctggctttccgtgttgcgcgcaccaatggcgccccaactcaccgcgtccgagatgaactgcgggctggtgggctccagaaattccgtggcggccgccaatccttccttcagcacaccaagcaaggttttgcgagcaagcaacaggcccttgcgaatattgtggctgccatcaatatccgggtcgttgatcaggcccttccagccaatggtagtgcgcggcttctcgaagtacacgcgcatgacgatgagcagctgttcaccgagctcatctttcagcttggccaatcggcgcgcgtagtccagcgcggccttcgggtcatgaaccgaacaggggccgacgatgaccaacagcctgtcgtcttggccgtacaggcacgcgcgaatctcatcacgcgagtaggcgacgatttcctgagcctgatcagtcagcgggagttcagcgagcacttgcgcgggcgtgggcagcggctccaactccaatacgcggcggttgatgatgcgactgacacccacctgatcttcccaacgcggcacatcagtggcaacgagcgggttcttcccctcccccatcgcctgacgaatggcgcgaagctcttctggggtgttcaacggctgcggaccgacttgcaacggatgcagcgaatgtgctgcttcctcctgctgctgcataacatctctccttgggtcagtatccttcccaaggataaggtgtcacgggaacaaactgacatgaccaccgttattggcaaaaaatgctcactgagtgggtctcagtgagcatttttacaaagacaaagctatttagccgagcggcgagcggtgacggcgtcggctagggtgtgcagcagttcgttggtgcgttcccacggcacgcaagagtcggtgacggactgaccgtagaccaactggtcgagcggggccggcttttggtgaccgccgaccaagaagctttccatcattacgccggtgatgccttgttcgccgtgcgccaggcgctcagcgatctcttcgatgacttcggcttcgcggttttcgtctttgccgcagttgccgtgggcggcatcgatgacgaggccatgctggctcgggccggacgctttggaaaccttgaggtcttccagagcttgacgcacggattcggcatcgtagttcgggccgtggctggagccgcgcagaaccagatggcaatccgggttgcctttggtttcggcggaaatcacgcgaccgtccaagttaatggacaggaagtgatgctcgaagccggccgcgaaacaggaatcggcggcggccttgatggagccgtcggtggagttcttgaagcccaccggcatggacaggccactggccagttcgcggtggacttgggattcggtgttacgcgcgccgatggcaccccagctgatcgcgtcgcagatgtactgcggggtgatggggtcaagccattcggtggcggcgggcaggccgaggctcagcacgtcggtgagcaccttgcgggccagccacatgcccttacgaatattgaagcgaccgtccagatcggggtcgttgatgaggcctttccagccgatggtggtgcgcggcttctcgaagtacacgcgcatcacgatcacgagtcggtcttccaactcgcgcttgacggcagccagcttttctgcgtactcgtgcgcggccttcgggtcgtggattgagcaggggcccacgatgacgagcagtcggtcgtcgcggccgttgagcacatcgcggatttcctgccgcgagtggagcacgagctcgctcatctcatcggtgagcggctgctccctgaggaaagcacgcggcgcgggaatggggtcaagctgacgaatgttgacatcgacggtctcaggaaagacggcctgctcccccaaacgacgttcatcctcggaactatccggaccacgtagtgctgccattgctcgactcctttccttgtatacgtactgtcggtatgtcgccatagacgcaaaagcccaactatagcagtttgttacggggactgcttgttgggccggcagttatggactttgggtggactcgcctgtgtggactcgcctgcggcgatgctgtgttgttgtgcggcctgcgaccgcggtctctccctctgtcagcggcttcgcgctgacagagggagagaccctagcagccgacaggctgcgagaaaacacagcattggccgtcaggccgattccgggaggctgacgaagtcaggccaaagcgcccatcggatcccatgcggggagcatggtggctggctcttcgagggccttctggtattcctcgggcaacagggccttcgggacggctacctcgtagacgtattcggtgaaccagtcgtcggacatggtgaagtagcccttgtcggcgatcttggcgccccaagagttctccacgcgccagcggcgggtggtgccgtcgtcggccacgtcaacgccggcgaaagccatggcatggttcatggcggagtcgccgaagcgcacgcgggcttccttgtccaaatcgaagtccacgtcgtacacgcggccgtactcgaacaggtcggtggcccaagcgccgttctcacggtccatgaacgggtggcagtcggcaccgaaccataccggaatgccctgctcaacgagaatctgcttgacgcagtccttcatgaactggtttggcacgttgaggtactcggtggcgtcgccgccagccacattgccgaggtgctcgatgccgatcttcttgcccttggcgtgctcggtgcgcggatcgtccaccaggcacacgtagtcctcaagatcagccggacccacgtacttcttccagaactcaaccggcgtaatctcgccgtcgcggtggaattcgccatccttgtcggtccattcccagtcgaaggaaaccggcggctcgcccaggtggatggtcagaatacggtggccggcagcagtggcgtcggcaataatcgcctcgaccttggaggcatcgccgtcagcggcgtacatgtgcgccacggcggtgtgcagcatgtggcgcagctggatgttcatttcaccggtgttcttggaggattcggtctccgggaacaggtccttgggcacagcgccgtacttcttgtacacgttcatggccatggtccactggccgccatcgcccatcacgtcggcgagcaggtgctgcatcaggcgggagtcggaaggctctccggcagccaccagagcggccacatccttaaggaagtagttgacgcgctccagcttgtcgtagtacatcgcgtagttctgggagaactcgaactccttcaagttcatgttcttcttggccacgaaacgggccacgttcagggagctgaacagccagcagcggccggagcgatcctgatgggtggcttcgccattgtcaacgatggtggagaaacgacgctgcatcagacgagcgcggtcataattgcgagccaccttgtcgatgccggcggcggtcaccgcgttcatggccagacggttggtgccgctctgtgcgaaatcgccgcgcagggtattcaacgcttcgtcggtcagaggcgtcaattcactcatgtcatactccttctgtgatggtgcgcttgtggcgcagattcaaacgaatacggcacctggctcgaaagcgcaggtgccgtaattcttaccgctagtagtctaatcgaaggcctgtcattcgccgttctgctcagatacggccggattctcctgagtcggggcctccggttcgccctgtgtctggtgctcggacggctcagacgattcggactgctcattctgcgcagccgaatcagccgaatcagccgaatcagccggtgccgcatctgtctcattgtgatcgtcggcagccgactcgtttccgctcaactcacccggctggtcatcggcctcgttgtgtacaggcttgacttccgggacgggcgcaaccaccggcaatgccgccgcggcagcggcttcctgatcctgaccagaggccgccgcattaccgccgaaagcgaatccggagaacgcctgcgagaacatagaacgcagttccgaaacacgctgggtgatgacggactcgcgttcctgcagatcggcgatgcgcttggacagaccgtcaagctcgctttgggcggcggcgcgacgctcctcgatctgcgcatcggcttcctcgcccgccttatgtacgattgcggcggcctggatgtccgcctcctcgcgcttggacgcggcatacgaatcggcttggtcgcgagtgttcttggcctgaccgaccaactcatcggcttcccgcttggccgccacacgacgctcttcgaggtgctgcagcagttcgttgaccttcttcgtggcctcatcctgctgagcggcgatgtcgtgacggatctgctcgacctcggcgttgacctggctcatcgtgctggtgcgcttgacctcggcctcatcagtgatttcctgacccttggttttggccgcatcaatgatttcgctggccttgcgctgggcttcggtcatcatcttggacacttgctcgcgcacgtcggcgagcttcttgttggcctcggcgagcgccgcctcaatctgatcgttggaatcagacttaagcttggtgatctcctcattggcgcttttgcgcattgcggcaacctgctgggtcgcctccgccttcatgtcggcgatttcgcgctcttgagtggagcgttcggaagccatcttcttggtgtgctcttcgcgcgcgttgctgagctcaagctcgacggtctgacgctgttcggtgatggtcttggcagtttcggagcgcagttgtgcggcatcctcgttggcggaggtggtcactgattcggcttgattgctggcgttcgtcagaatcgaggcggccttggcattggcgtcgtcaacaatatgctgggcatccagcttggcgttgttgatcagtgtttcggcctgagcctgagccgtggtacggatggaggacgcgtcctgcttggcgcgttccagcagttcggtactcgtctgttcggcggaggcaagcatctgctgggcgttcgctcccaaggaagcgaagctgttgccttccggcttcttgttcttctcttcctgaagttgggcctgcagttgcagaatacggtcgtcatccgccgcaatctgctcacgcatgctggccaacgtctgctgcgcacgcttcatactctcctgagtagcgtcgaaggcagcatcaaccttctccttgtcatatcctcgcagcaccaccgggaaacgatccaccatcgctgtttattcctttcgcacacgcataaagctcttggcacatccttgaagcactgtagcgcatcgcactggcgctgagcgttgagcgacgcgcaatcgttacaatgcgtgcgaaccatgttctattccggcgtggcgcacagcgtgctaggcgatgaggatgtcggagctggagggcttgagatagtagcgcacggcttcgcgcaccacatcacggccagcggcgatctgctggtcgagtggtagaccatgctggctggaatgcgccggaacgaccggagggaagctgacgaatccgcccagcacctgctcctgggtggcggtccagttgagcaagttgtagaacagcgaattacatacgaacgtacctgcgtccgaactcaaggtggccggaatcgaatcgtccgtgaaatcattcaggatcgagcgcaacggcaggcgggtccaataggcggccgggccattggggtcgatgggttcgcggcgtgggatcacgttgtccgcgtctggcttgatcgcgtccatcaggttggtggcgcatcgttcaagcatcacgcctcgggctgcgtgcttgagcccggtggcgatgacgatattgggcttggtggcctcaatcgtctctttcagcgtgggccaggctttggcgaagctcaccgggatgctgacggcatgaacggtgacggcgacctgctccaacggatcgtccggagcagaggagacgcccagtccctgctcggcgatggccttgggcacttcgacggcgggattgacctccacgccgtcataatggtcgaagccggagatcacaacattgagttcacgcataatgccagtctagcgatgcatctggccggccgcttgggccagcagggcgtgcatgcgggcgcgggcctcttccttgggatcacgaccgagaatctcctcggcgatacgctcagctgtgggaatatcttccagcgtggtgatcttcaggttggtttccgcaccggagacaatggcgacgggttcatcaggcagataatcgaccactacgcgcgtgtcgtcggtgggatggaagtccgggtcggcggcagccaaatcgtaagcgtgacgaatcgtcgcgaagcggaaggattgcggggtctgcgcgcggaaggtgttcgggcggtccggcaccgacttgaccactttcaaatcgcccagatcctcggtcaacagcacggtgtcggttgaggcgtaggccacggtcgcggccgtgaactggtcgagcgcatcaatcgaaccgtcgatggcggactgttccacgaacggacggacggcgtcatggatcagaatcttggcatcgtccggaatgccagccgtagccagcatgtcgagcgcggcggcggtactgtccacacgttcgtcaccgccgtcaatgatgacgcggactttggtgtagcccatctcgccaaccaacgtttccacttcaccgcgcaccttgggattgaccaccaccacgatgtcgctgacgcgatcgcaatgttcaaaggcatcaatgctccagcacacgatgggcttgccgcccacggagacaagctgcttgggattatcggggtcgaagcgcgtaccgaagccggcggccagcaccacggccaccaccggcacggtttgcgccggtttggcaccctgagcgggggccggttggacggtaggcgtctcgacgggggtatcgaaatctctctcagtcataggcaccaccgtaaggtgagggctggccgtccgtgaactgcatcacatcttctccacggaatgtgctcgcattctccgtttagtcacgcacgatgagggcgaggaggcggccttcgtgtgttttgttggcgagcgcggcgcggcggtgcgagtaccacagtgggttttcgagcgtgcacatgctgtggctgatgttgtcgatgcgctccgcgagctcggccgggccttcgccgtccgtacggcacagttcggcgagttccgggtcttcctcaaggtactgggtggcggcgtgcacgcgcggcatcgaatcgaccacctgatgtacaccggcgaaggcgaggtcgatcatcgcggcttcggcgatgtcgatgccggcaccgccgaaacgggtcttcgtcttggtcagcgggaagcgcttgatgaactggtcggcgatctcgtcgcccacttcatagcagtcgccgcagatgcgcgggccgagtgtggccacgatgttcgccgggtcggcacccttgctcttcatcaggtccaccgtggcgccgatcacgccgcgctccagaccacgacggccgcagtgggccgcaccgatgataccggtgaccgggtcgcccagcagcaccggcaaacagtcggccgcgaacatgcctagggcgatgccggattgtgcggtgacctggccgtccgcctcgatgacgtgcggagtgtcagtctcaccatgtgtgccggacacgtcgaagccgaagggggtgttgatgacgaacgagtcgtccacgtccacagccacgccggaatgtacttgggagaccagcgataggcgggcttgcaccgcttcggcgagtgcgatgcggttcgacagcacggcctcaggttcgtcgccggacttgccgccgaggttcaggttgccgtaatcgccggcgctcaggccgcccagtcgcgtggtgtacaccaccttgatgccgggggccagtgcgatggggatggtcaccggaatagggcgaccggctttatcggtagagctgatgctgttggaatcgaggatttcttcgctgtattcaggcataaggcattctttcttgggtgcgggcggtgttcatgattttcatgaccaccccccccagtcagcggggggcggagggcggattctagtggtggttgcaacacctgaggtttgagcggccttccatggtcacgttaactgttagaattacaggaccaacaagggtgttgcacttctaaatagacatcgggttttttatagtttattgcagtcgcagtagttttagcgcaacggatatcagctgatcggtacgggtcttgatcgcttcggcattccatttggttatctgtgaggctcagcccatattacgcggtataagcgttaaggagcaatcaaagggcggtctttctgagattagtctcagaaagaccgccctttgcaatggaataaattgagtgtggaactcggtattggtttgaaagactgtttacagcccgggaatcagaccgccgggcggatcgagcgtgaggtattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgaaccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccaatgtcttccgggttcacgcgtacgcgaagcagttcgccgcgcgcattctcatgagacttgacggaaacatcgtcgggaaaatcaacgatgttcttgatgaggtgttccacagcctgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggttctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcggtcagacttgatctggatggtcgagggctgggtgttggggttgtaggtaccgatctcctcgatgaccttgccgtcacgcttcttgcgggaatcgacgaccaccacgcggtagaaggcgtagaacttcttgccctgtcgcttcagacgaatcttggttgccaaaatggctctccttgtaataactaggtttgtggtttcgcggctaccatgtggggcatggcccaccggaatccacgtgtcctcgcggcccggggtgtagagggcgccacgcgcgcgcgaataactggcctattatagcgcgcagggcaggactggcgttgggtgtcgtgtgccactgccgacgcgatgtatgcatgacatattccgaagaacaatgccgcgaaacggctgacgtagacgactatcgcagtgtcaacgtggcgacgagtgccagatggtcggtgtccttgacttcgaacgatttgacgtgtgacggctgtacgccgggtgtgaacagcacgtgatccaactcgatgcgtggccacttgagccagcgggggaacgtgaggttcgggccggccgcttgggtcaggctcgcgtctttgaagccggatttcaacagggcgcggaaactcggatggtcggtgctcgagttgagatcgcccataacgacgacgatattgcgattgctgacggattttgcacgggcgagttctcgcagacccaaaatgccggccgaccaatccgcgcagccgcgcatcggcgatttcgggtgagccgaacaaagcgtcaccgtgcgattaccggaggttttgagggtgatggcgggaacgtcggaggcagggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacggtgtccatcggagatcgtttcgggcccttccttcggagtgtttgaggcacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcagcgaccgcggccagaatcatcaaaggaacccacaacagcggcgtcagggcaatcatgtacggaagcggcatacgggcctcgagaccggcgggcagcgcgcttaaggccgtccataacagtgcgatgattgccactgcgctgaggattgtcgtcatggaagttcctttcgaaatataaattgaaccgagatataacttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttgtcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccttctcatcgaactgctcgagttccttgcggtgctgggccatgcccggaatcatgccgagcagcgacttcatcgagcccagcttgcgcacctgctgcagctgatcgaggaagtcgtccaggccgaaggaaccttcggaaattttctcggcggccttgcgggcctcttcctcatcgaactgcttctgcgcctgctcgatgagcgtcatgatgtcgcccatgtcgaggatgcgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccctcgtcaaaggccttggcggtcttgacggcgtcctggccgatcatcgcgtcgatgacgaacaggatttcgttggggtgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgactacctgcagctgcgtcaccgcgttcggacgctgcaaatcggccgccaccagcagcggcgtgtggccggaatccttgagccagtagccgagcttgccggccagcgtggtcttaccggcaccctgaaggccggcgagcatgatgatcgtcggcgggttcttcgcgaagttcagcggacggtcgacgccttggccgagcacgtcggtgagctcgtcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtaccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgctttccggggaatgtgccgcgtagtagtcagggatgttgggcattcagacggcaaatgccgtgccgtccgctcgtggcgaagccaatcgagtgcttccgatatcatggaaaccgtaaagaatcctgtgttttttggaatgcttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcgtggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatttgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcggcctatacacgtattaccggcgctccaaccgctccatcggcgattccagcaccatgctcaccgccgagtgcaagagcacgttggtcgacggatcgatgtcgttcggcatcggcgcagttgccatcttcctgatgctgctaccggccggcggtccgcttgacttcctgcactacaccggcgatttcttcattaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagccgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaagtccttggccttgcgagcttcggcacgggcgttgagctgttcggcgatcagtgcctccagcgctgcatgctcgggagactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtgttgccggaacggatggcggtgaagattgcggcggttgcaccagacacattgacgtcgtcattcatggctgccacgaaatcggcgggcaaatcgtcggcggagacggcagtgacttcctcgcgagaaggctggccacccagcgccacaccggcgcgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaagggtagccggccgcacgggtctgcgccatttcgttttcgtggtgggggaagcgcagatccagaccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcgtcggccgggtcgaccggattgtatttgtcggcaccggtggcgtccacggatgggcccatgcggtcggccacggcggcggcctcatcgacttcggaggtctgcttctggtgagtaagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggctccacggtgggcggcagtacgccgagcgtgttgtatgcctcggtgaattcgcgctcgtagtaataggcgcgggcccaccaacgctggcctgcggccgcggccttatcgagaatcttgtcatcgatatcggtcacattacgcacaaaagtgactttgtagccgagcttcaaaaaccagcggcgcacgatgtcgaacgccacggcggcacggatatggccaatatgcggcgacgactgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcaggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgagcctcgaagacatcggtcttgagacggtgacaatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagatcgggttcgcgccgatcaagcgtgtggacaagcatgacttcttctccatgtgggataagcagctgacggtgctgcactggcataacgacgtggtgggcttgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgaccgccaagccgatgtgcgtgaaacgaagcgccgcaatctggctcgcaaggagctcgcatggctttcccgcggtgcccgtgcccgctccaccaagcagaagttccacgtcaaggccgcacgcgaattgattgccgatgtgccgccgatgcgtaacacacttgaactgaagcagatggccacctcccgtctcggcaaacaggtggtcgatttggtcgacgtgacgcagattttcgaaaaaccgcagggcatggccgatgtcgacccggatgtggcggcgctctccgcgtccgcttcccgcgtggatgtggtcaacgccatgtacgccgagccgcagctgcacggttccgttgaggtggcggtcaccgacatgactgacccgcgcctggtggacgccggcgtgccggaagccgtcgaggccgctgaggaagcgcgtaagaaggccgaggctgagagcgacaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgtgagattttggatgatgtgacttggctgattggccccggcgaccgcttcggcatcgtcggtgcgaatggtgccggcaagtccacgctgcttaagttgattgatggcacgctcaccccgaccgcaggccatgtgaacattggcaagacggtgaagttcgcggtgctctcgcagcgcctcgatgagctggagaagctcggcaagtacaagatcaaggaagtactttcccgctataagccgagctacattgtggatggcaaggaagtgacgccgggacagttgatggagcgtctcggcttcgaatccgcccagctgatgacaccgatccgcgacctctccggcggacagaagcgccgcatgcagttgctactcatcctgctcgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgccctgctcggcggcaaggtacgccatctgcccggcggcgtgcaggactacctcgatatggttgaggctattaagaacggcaagggattgccggctgacacgcctggcttcgcgggcaccggtagcagcccggcgaagtctggtaagggtaaggcggccgccgtcaacgctgccgcatctctccctcagtccgcttcgcggacagctccctcgtcagagggagccaataacggtgaggactccacctcgaagctcaccggcaaggccttccacgaggcatccaagcgcgtaaacgccatcgagcgcaagcttgccaaactggaagagcagaagaccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggtagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggcgtgcccctgtgttcgcgttcgacaaggatatgggcataatccgcagctgcctgagtgtcaaatgcgaacgttctgtcctctaatgtcataagcgccagtttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatctcgctcggatagtgggagttcccccttgtcgagtccctcaaaatccatgttcttcatgaattcgcggatctcgtcatagaaattggtctttcgcgtgatttcatgcgccaccgtgccggccagccattcttcaagaatggatcgcacctgagattccatggagcggttgtttttctcagccacttctttgagctgttgaatctgctcatcgggtatttttcggatggtcaatgttgccatgatgcacctccttgttgctgtcataatgctagcatgaggtgctgtcgttttgcttgcagtacgggtgatgaggtatgcacgtatgaaaaaggcggatatgcatcatgcacatccgccttttgagcttggactgggtctccccgcagtcgccgaatcagcgcccggtaacctcggaaccgatcaccttttcgctcagggcgcgcgggccgcgggtcacggctacggcaccggagcgcaccagctcgatgacaccgtaatgctccaaaagccccagcagcgcatcgatcttaccttcggcaccggtggcctcaatggtcagcgattccggattcacgtccaccacacgcacgcggaacaggcgcacgatctccagcacgtcggaacggttggattcgtcggcggccaccttgatgagcaccagttcgcgttccacggtggagttcgggtcgagctccacgatcttcagcacgtgcagcagcttgttgagctgcttgatgatctgctccagcggcacggcctccacgtcggcggtcaccgtgacgcgagagatgtccggacgctcagtgggggagacggacagcgagttgatgttgaacgcacgacgggcgaacaggccggcgatacgcgccagtacgcctgggcggttctccaccagcacggacagcgtatgacgctgggaaccaggctgggatgcaggatagttagccatgagtgttctcctctcctcagtgctcgctcgcagtggcagcggcggtctcgtactcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgactcgccgtcgacgccatgcgcctcgccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaactcgcgggccgagcccacggatgcgccgatggcggctggcaggccgtagcccatcgtgccgaggcctccggaggagatccaagcgtgctggttctcaaaatcgatgaactgcgaggcccacatctggtgctggcccacaccggtcacccagatggtggacggatcggccatctcagagagcttcttgatgacccactgcggggccagcgatccgtcggtcggctcatcccacatcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaacgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttccccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccagaaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtgttgtttgcgatgcgatggtgtacgtaacggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaactccgttcaggcgcgcgtcactcggcctgctcgccgttctgctcggcctcgagctgggctttgagccccgccaatccggcaaaacggatatccgtcacatcgtgatgatggtcgggatcctcgttcagatcggcaccgcactgcgagcacaggcccttgcaatccggtcggcacagtggctgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctgacccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttattcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccttgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcttgtgcccgggtctgctgagctgcttgggcccgcgctttggcctgcatctgtgccggagtgggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcaggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgcgtgcggtgccgtatgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatgcgaggaaagaagtgcaccatgacttttgccgatctgttcaccaatgacgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtccccaagcacgacccgtccaagtacccggtttgccccgactgcaagcggatttacgaggaaatgacgcgctaaaggtggtacttggctcccctcagcgaggggagccaaaatggtcaccgagccgaaatctcgtcgatgagcttgagctcctcgtcgctgaagtgggtgttcttcagcgcgccgatgttgtcgagaatctgctgcggcttggaggctccggtcagcacggaggtcactttgccgtcgtgcagcagccatgccaggctcatctcggccagcgtctggccgcgttcggcggccagattgttcagatccatgacctgcttgtgcagtttctcggtcagagcggaatcgttgaggaatcgcggatcgtgagccatgcggctgtcggccggaatgccgttgagatagcggttggtcagcaggccctgagccagcgggcagaaggtgataaggcctttgcctagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcgtagccggccttggtggagatgacgagttcgtcgcggtgatgtttgaaatacttggcgagcagcagtccgcagttcttctcggcctggccgggttcggggccgtagttgttggctaggtcgaagtgggtgatgccgttgtcgaaggcggtgaagaccaaggacttcatctggtcgaatggcgtgatgtcgccgaagttgtgccagaagccgagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcaaaccgacgctgattgagcggtattcgtaagtgttcttggatactatggttccagttcaagtgaacttgaatgcaaacggctgcgacgcttcggcgtgttgccgcagtaaggagtcatgatgtcctacaccattcgtcaggtggccacgcaattccatatgcagccctctacgctgcgctattacgaggatcagggattgctgaccaacgtggagcgcaccgaaaccggccagcgtatatacgaagactgccatatcgaccgtctgcgcgcgatttgctgcttcaagaacgccggcatgaccattgacgatcttaagaagttcttcgtgtatgagtccaatgagcccgagcatatcgacgaaatccttgatctgctggaatctcgccgcgaatccttggacgagcagcgccgagccctcaacgaggcggccatgcacgtgcagcgcaagctccattactatggcgacatcaagcgtgccatcgacgccggtgaagactggccggattggcgcgagtacaaaaaccgcgcctattccattgaatgttgagtccatcgagtgctgaggccatcgaatgttgaggccatcgagtgctgtgttggataccggctgggcaccaagaccgatgtgcgtcgatcatgggcgcgtctatccgagtaaggccttgctcggcagtgcgcggtcgagcagccagacaacgagcgatatcacgaagaacgctatggccagcttgccgcagctaatgccgaacccttgccagccgagtgcgtcaaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcatcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatgaatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggtcgaccgtcacgtggtaagccccgagaccattaagtggctggagaacttccgcttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccatcggcaccgccgcgcattgcttcacgttggtgcatgattccgagcgtgacgcctttgaatcgcagatcgaggcattgggcaagaacaccacgctgctggtggacacctacaacatcgaggaagccgtgaaaaccgccgtcgaagtggccggtcccgaactgggtggcgtgcgcatcgactccggcgacctagccgccatggcacagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggacaaggccacagtgcccggtcgcaagttggcattccgctcctacgaatacgcgctagccgaagccgaacacgtgatttccggctcggaagagaaactggccggtttcacgcccgaaccgacgtggaagaacctgctggtcgatttcgtggaccacggccatatcgatgcgcagtggcagggccatgacgccatcatggccgcccacgactaccgcgccaaggcgttgtccgaactgcccatcaccgcacaaagcctgatgaagggcgagcccgtgattcctacggagactcaggttctctgacgagaactttcgtctccataggaatccgtcgcagcatagctgctccccttacctacggacagcccactgggctgtccgcttaacggttcgaccacagagaccaaagtcctctgaccgtatcgcactggccgcatccctctggttacattggctactcttccctctgtctgtgcccctctgtctgtgttggccgcactcctgtggtcgccgccgaggcggggagatgcaaccccggtcgcacccccgtgtttgcaccccctgtggctgtgtcccggggctgtattggccgcgtcccctcgggctgaactgcgtcccggttcgccggacgtggttccagctgagggtgcccggcggattctagtggtggttgcaacacctgaggtttgagcggccttccatggtcacgttaacgtgaccatggaaggccgctcaaacctcaggtgttgcaaccaccactagaatccgccactgagggggagtatgacgcgggggtagtggtctcatgaccatatacgaatgggggctgattccaatcggaatcagcccccatagtgttgcaactagagattggtgagatgcctaacggcggttacttacttggcgaaggtgttgccgtaggtgtcggtgccggcttcggcgattgcggcggacttgcgggcgatggccagctcttcgttcgtcgggatcacggcgatgatcacggaggagtccggagtggagatgatgcgcggttccttggagcgggtggcgttcttctcctcgtccagcttgacgccgaacggagcgagcttgtcgcacaccatcttgcggaccacgtcgtcgttctcgcccacgccagcggtgaaggtgatcacgtcgcagccacccatctggtaggtgtagttgccgatgtagctgacgatgcggtgcacgtagacatccagagccagcttggcgtcctcattgccctcggacaccagacggtgaacctcacgcaaatcgccatagccggtcatgcccatcatgccggaacgcttgttgaacagggcgtcaagctcgtccacgttcatgtgggcgttgcggatcaggtggaagaccacagccgggtcgatgtcaccggtacggccgcccatcatcaggccctcaagcggggtcagacccatggaggtctcaaccggcttgccggagacctcagcggaagcggaagcgccgttgccgatgtgcaaaacgatctgcttcaggccttcagccggcttgccgatgacgtccggcaccacggaggagatgtactcgtgggaggtgccgtgggcgccgtagcggcggatgtggtactgatcggcgatttccttgttcagcgcgtaggtgctggcggccttcggcagctggaagaagaaggaggaatcgaagacgaagatctgcggaacgtccggcagcagggagcgcatgacttcggcgcccttggcctccggtccgttgtgcagcggggcgagcacagccagatccttgacctggttgatggtcttgttggtcacgagggccggcttcgggaagatggagccaccctgcaccacacggtggccgacggcgacaatgccagcctcagacaggttcgggccgtactcctcgaagaagccgagcacgcgcttcagaccctgctcgtggtcgtgaatcggctcttcaagctcgtgcttttcgccgttgtactcgtgcttgtagtggccgtcgaccggctcaccgatcttctcgacgaggccggaagcgaggccttcgccggattcgagatcaaccagctggtacttgatcgagctggagccggaattgatgacaaggacggttttcgccattatgggcatcctccattgtgattgaatgttcccgtgagacacgggttaccgttgattagattactcgttgcttgctacaaaaaaggcattacggtggctcccgctggcgggagccaccgggagccaagccgggctcactgcgcttcgatggcggtgagggcgatggtgttgatgatgtcccgcaccagagcaccacgggacaggtcgtttaccggcttgttgagaccctgcagcaccgggccgatggccaaggcgccggaggagcgctgcacagctttgtagccgatgttgccggcgcacaggtccgggaagacgaacacgttgacgtgtccagccacatcgttgcccttggccttggtggcggctacggtgggggaccaagcggcgtcgaactggatggaaccgaccaccggcagatccggagccttctccttgagcagcttggtggcttcctcgaccatgtccacgtccggtcccttgccggaaccgagggtggagtaggagagcataccgaccttcgggtcgatgccgaaggcacgtgcggtctcggcggactgcagcgcgatttcggaaagctgctcggcgtccgggttgaggttgatggcgcagtcggagaacacggccacatggtccttgaagcacatgaggaatgcgccggagaccagcttctggccgggcttggtcttgatgacctgcagggccgggcgcacggtgttggcggtggagttcacggagccggagaccaggccgtcggcgtagccgagcaccacgagcatggtgccgaagtagctggcgtcggtcagctgcttgcgggcctgctcctcggtcatgcccttcttggcacgcaactcgcacagcttggcgaccatgggcttcagcacgttctcgtcgtccatagcctggaagcgggcgcgatccaagtagttcaggcccagttccttgccgcgagccagaatggcgtccttgttgcccacgatgatgaggttcacgatctcgcgctcaagcaggtagtcggccgccttgatgatgcggtcctcctcgccttcgggcagcacgatggtcttcttgttgctcttggccttgccgagcaggccgaactggaaggcgtacggggtgatgggcgcggtgacgtccacatcgagcgcggcgagcacttcatcggtgggagcgttcttacggaaggcctccagcgccagatccttggtggattcatcggtgaacggcacctgcggaagagtccagaccggcaggccgtacttggcgagggtctccttaacggagaaagcgtggcgcggctcgcatccggtcacgaagatgccgagcaccttgttgccagcggcctccatgccctcgatggacagcttgacggtctcgtcgagctcgtgcggccaacggttgatggtgcacacggctaggaacacgccggccttcagatcagcggcgacattcgcgtcgaattcatagctggtcggatcgttgacgtgggacttgtcggtgcccacgatcagggcggcgtccgcgcgggaaacgtccatggcatcgttgaacgcgccgacgatatcgccacgggcggtgttcttatcctcgcgcaccttgtgcacatcgaggccggtggacagggccacgccgagtccggcattggaggcggcgagtaggatcggggtgaattcgtcatggttggacacagcagggcggaacaccatggtcttgtacttggaagtcaatgcgttgagcatgccgtaagcgacgacgttgcggccattggcgccttcagggctggcgatatatacacgggtgacggtcacgatgtttttgtctcctttgatgatcaacacgatagggaccacacctcattgtagtggcgattactgttatcgctcacgccggtgtcgcgccaatcggaagcgtcccctttgcgacgctttccggggaatgttgcgcaaaaccccaaaagtcggccgataggccagaaaacgaaaaaggccggtgcgtgaagcaccggcctcgattgtggagctagggggattcgaacccccgaccctctccatgccatggagatgcgctaccagctgcgctatagccccgagtgaagctatccgattcatgggagtcgcaagacccgccatgaaccagcggagaaaccaccatatcgcctgacttgatggcttcgtcgtggagctagggggattcgaacccccgaccctctccatgccatggagatgcgctaccagctgcgctatagccccgctttcagttgttggcccgttgtttggacctcgtatacattacgacgagatgtcgattctggcaaaagccggcgtgtcgccaaatggcaaaagtgggatttggcgacactttttggcttgtttccgccattattcaggcattgggttattcaattactgcttgaacggtttttcgaatacactgaacctgttggctcagcaggggagccgtgacacgatcagcgttcgcgttcccactcgtcggtgtcggcgatggccggaccgtgattgtagtccagcagacgccagcgcacagtgccatcgggattgtccatcggcaccaagcgcacccagtgcgcattacgcaatgaaaccaccgtggaaaaggtcggatcgattgcagaaatgcccaacagggtctgcaatgtctgcgcaatccatgcgccgtgcgagaacacgaacaggtccgtgtcgtctccggcacgcgtggaccagtcctcaagagcctccacgccgcgcttgcccacagcttccttgggctcggctccatacttcagctcgccgccccgagactccatccaggaacggaagtcctcggggtagcgttcggccagttcggccacggcatggccatcccaatcaccgaagctgcgttcacggacgcgacgatcatcgacgggctcgattccacccaatacgtcggcgaaagcttgcgcggtggcgtgcgcacgcttcaaatcggagcagacaatgaaccggtggttgatttccggccgacgatcgacgtacaggcttttcaaggccgcggcggtctgcttgacctgccattcacccacggcgtccagcggaatgtcgacctggccttggagcttgtgagcggcgttgtaggaggtacgtccatgacggataaggaaaacggaacgaacatgattggtcatagtgacgatcctttcggttccagtgaggaaacaggaaaaagggagggctgcctggtgccgtcaatgacgttcggcaacaggcagcccgacacgcgaatatcagcgaatatcagcgaatatcagcaagtatcagcgttacgcgattcgcacgttacgcggtggtgacggcagcatcttccgcatgctccgccgtttccgggtgtgcgagttcaagatcgatggccgggcagtcgcgccagagtcgttcgagcccgtagaattcgcgcgattcctcgtgcatgacatgaaccacgaaatcaccgtagtcaagcagcacccactggccctcggtcaggccctcgcgcgagcgcggctggcggccggagcacttaaggaacaggtccttttcgatttcctcggccacggccagcacctggcgctcgttggaggcgccggcgatcatcatgatgtcggtgatgccgagcaggtcggctacgtcgaaggccacgatgtcggtggctttgatacggtccgcggcctcggcggccacgcggacggcgttgatggaatcctgaagtgcgggcatggttcagcgctcccaggcgggcttccagccctcgacgttgtgttgcgtattctcggagtagaccatcgtgtcgctcggcacggcgtggcgcaccacggaaccggcgccggtggtcacattgtcgcccacttcaaccggggccacgaacaggttgccggcacccacgtggcagccggagccgatggtggtgctgttcttgtgcacgccgtcatagttggcggtaatggtgccgccgccgatgttggtgtggtcgccgagctgggcgtcgcccacgtagctcaggtgcggcaccttggtgccgttgccgatgtgcgccttcttcatttcgacgaacgcgccggccttggcatcctcgccgaactcgttgcccgggcgcaggtaggtccacgggccgatgttcgtgcgtgcgccgatgtgcgattcctgtacgcgggaacgctcgaccacggcaccttcgtccacggtcgcgtcgatcagggtggtgtacgggccgacgatggcgtcctcgccgaccaccgtgtggccttgcaggaaggagccgggcaggatggtggcgtcgcggccgatctggacatcgtcctcgatccaagtggtttccgggtcaagaatggtcacgccgtcgcgcatccagcgctcgcagacgcggcggttgtaggtcttggacagcgcggccagctgcacgcggtcgttcacgccttcgacggtgagcggatccggagcagcgaacgcgccgactttgccagcggccttggcggtttccagcgcgtcggtcagatagaactcaccctgcgcgttgttcgacttcagtccggcgattgcctcggtaagcacggaagcctcgaacacgtagactgaggtgttcacttcctgcacggcgagttcgctgcggttggcgtctttctgctcgacgatgcgcagcacgttgccttcgcgatcgcggatgatgcggccgtagccggtcgggtcatcgaggatggtggtgagcacagtggcgccgttgccggaggcggtgtggaattcgaccagacggtgcagcgtctcgctgtcgagcagcggcatgtcggaggcggcgatcagcaccgggccatcgaccttgccagcctcggtgagctgcgccattgcgcactgcacggcgcggccggtaccgggaatgtcgtcctggttcacaatggtgacctgctcgtcataggagcgggcggcttcggcgacgcgctcggcctggaagtgcacgaccacggccagcgtgtcgggattcagggcggccaccgaatccatgaccctgttcaggaaggtcttgcctgcaaaagcatgcagcaccttcggcttgttggaacgcatgcgggtaccctcgccggctgcgaggacgatggctgcggataatgccataactgacgtattcccttcgatcggaatgtctattgagggtggaaacacctcaaaacaatagacggccgcccggatgtcgagcggccgtcagccgttcccccacctggactcgaaccaagacaaagggttccaaagacccgtgtgctgccattacaccatgggggagtcgtgggctttcggcccacaagtgttcatttataccatattgtcggtatttaccgaaagactacgccatgtcgcgtctcgcatcgtgtgctttccacgaacaaacacgcacgtgatcaggcgaacaggaagccttgaccgtggtgctcggggtaggtgtcgaacagttcggcgaccgagccgtcctcgaatacggcgcggatggcgctggccagcagcggggcgatcgacaggacggtcaagccatcccagcgcttttcctcgggaatcggcacggtgtcggtcagcacgacctcgcgcgcaccgcagttcttgagtcgctcgacggccgggccggagagcacgccatgcgtggcgaccacggtcaccgacttggctcccgcgtcctgcagcacgtggcatgcgcccgcgatggtaccggcggtgtcgatcaggtcatcgacaagcacgcagtccttgccggcaacgtcgccgaccacacggttggcgaccgcctggttcgggcgggtgatgtcgcgcgtcttgtgcacgaaagcgagcggaccgccgccgagacgctgcgcccactgctcggccacgcgaatgcggccggcgtcgggggagacgacggcgacgttgtcgagatggccctggaaacgatcacggatgtagtcgaccagcactggcatggccaccagatgatcgaccgggccgtcgaagaagccttgggactgcgcggcatgcagatcgaccgacatgatgcggtcggcaccggcggtcttcagcaggtcgaacaccagacggcaggagatgggctcgcggccgcggtgcttcttgtcctgacgggagtagccgagcaacgggcagaccgcagtaatggaacgggccgaggcgcgcttcaatgcgtcgatcatgatgagctgctccatgatcgccttgttgatgggcttgtagtggctttgcagcacgaacacatcggcgccacgcaccgattcagtgtagcgcacgtacatctcgccgttggcgaaatcgtatgcggtggtttcaaggacgtcgatgccgagctgctcggcgacatcctcagccaacttcggatgaatccttcccgtaacgagaataagattcttatcgggctttccttcaaggattgcgctcaccatgtctcccaacgtgtggtctcgttgatgcagtcttcagcatagccgttcttcacgaccggttggacaactcagcgttgcctgccgttcacctgccgcttgcgatccattgttcgatggtctgtctgaccgcctttgcatagatatcgctatccatgctcgggtggatgccgtcggagccgagcacctgcgcgttcgcgttggctgtggcatcccaatccaccagcaccacattgtccggatgtgcggccgcatagtcggcaagcacctggttggtaggtggaatccacgtacggtctccgtgggcattgaccagtaccagcacgcggtcggggccgatcatattacgaatctggtccaactgatcgggggtgattgccgaattggtgccaaggccgatcaacacccactgccgcagactgccggcggacagagcgttgccgatgagttcgggggcgaccatgatggagcgggaaacgctcgcgtcggtctgaatgccggggaagacttccgaaaggccctgtgatgaggccagcatcaccgaatcgcctatggcggtaatctgatcgccggtgggcatctcatgcttgggcttgggcggtgccggcacggcatggcgcagcagcacgtgttcggttttctgcatacgttccagttgtgcggcctgttgctccagctggatctgcatggcggttttcgcaggtgcatgagcaatgccctgcacgcagccggccaacgacagcaccaggataacgtcaacggcaataacccgggccacatgattcttcttgttcgtgcgaaggggcaccacgacggataccgccgagtgcgttgccgccggtttctccaccatcagccaggaaatcatcaccgcaatggcggtgagcaacgcggtcatgatgagaggccaaggccctactgccttgaagatcttcggggcaagggcgctggaaagaatccacaacggccagtgccacaggtagatgccgtacgaatacttgccgagggaggccaatggcttgaacaccatgaggctttgcatccaggaatcgtcggagatggtaccggcaatcagcagcacggacaacaagctggacaatatgatgccaccgcggaaggcgaatgcatcctgtttgccgataaccgccatggtgaccaaggcaatcaggctgaggaacgccaataccggtgccgccgcattccagatgcgatgctccacgggaatctgaggtaacggagcccgatgtgcggctgccgaagcgctcgagctaatggtgcggggcatcggcacagccctctggcgagcgtggcccaactgaggagcggtgacccaccaggcgagagccacacccagcatcaggcccatgctgtgggtatcggtgccgaagtagacgcgggtggggtcgcctttggtcacatacatcacccacatggcgatactgctgaacgccgcgagtcccagtgggatgagtgaagacagtttcgtctggcggagcttccacatcagccagacgatgaacggcacgatgacgtagaactgcatgagcacgccaatgaaccacagatggcgaaacacctgcgggttcatttggtcgaaatagctttggcctccggcaatggcgtaccagttgtagcagcccagcagcacggtgatgacttggtcgcggatggaaactagaatgtcgtgatcgaacagccagccgacggagacgatgaccggaatcagcagaaacagcgccggatagagacgtactgcacgcttgggaatatatcgcacgagattcagcgatccggttttcgccagagaacgaatcaaactgacggcaatcaggaatccagagacggtgaagaacacgtcgactccgtagaatccgcctggcagccgttgctgcatgcagtggtacagcacaatggctatcagcgctagtcctttaataccgtctaaacccacgaaccgcttcacggataatccttctctttccgtagtgctgatggcattccccgttctctccaacaaacggaaaacaagcccagcatggccgaggggagagacaatgcgacagcagcgaatcgtcaggccgcatgctgcatgattaccggcttgacgattcgcggcataccgcgcttatcggtggcgcttaccggtgatacagactcacccgttcgtacttcggttcgcagcacacgttgatgccgagtttgcgatacagcgcctcgtccgtggatgagatgataacggagaagaaggcgtcgcagccccgcaactgtttgagcccgtcgatgacgcgagcggccacaggactggtggcgctggtgattgacaatgcaatcagcgtctcatccgagtgcaagcgtcggttcacgctgttgagatgctcggttttcagccgacagatgggttcgatggcggcatcgtcgattaccggaatggtttcgtcaacaccggtgacggccttgagcgcgtgcatcagcagcgcgctggccgcgcccaacaggtcgccggttttgccggtgaccacatggccatcgggcagcaccatggcaccagccggggcaccggtggcggcttccttctcaagggccacggcgcgggcgggagaaagatcgggggtcacgccggcccggttcatgatggagcgcagccgctccacctgttcctcgccagtgccggtgcgcttcaagtgcacggcggcggcgaagtagcggcgcacgatttccagacgcgcggcatcgcggcaggcatcgtcgtccacaatggcgtatccggccatgttgacgcccatatcggtggggctctgataggggctttcgcccatgatacgctccatcatggctttgagcacggggaatgcttcgacgtcgcggttgtagttgacggtggtctcgccgtacgcctccagatggaacgggtcgatgatattggcatcgtcgaggtcgacggtggcagcctcgtacgcgatgttgaccggatggttgagcggaagattccagatggggaacgtctcgtatttggcatagccggcgtcgatgccgcgctggtgctcgtggtagagctggctcaggcacgtggcgagtttgccggagccagggccgggcgcggtgaccacgacgagcggccgggtggtctcgatgtactcgttcttgccgtatccgtcgtctgaaacgatgcgttcgatgtcgtgcgggtatccggcgatcgggtagtgcaggcggcaggtgacgccgagttgctcgaggcggtggcggtaggcgtcggcggcgggctgattggcgtattgggtgagcactacggagccgacgaggaagccgcgggaacggaacacgtcgatgagtcgcagcacgtcctcgtcgtaggggataccgaggtcgccgcgggtcttgcctttttcgatatggttggcgttgatggcgatgacgatttccacatcgtccaccagactttccaacatgcggaacttggtgtccggctcaaagccgggcagcacgcgcgaggcgtggtagtcgtcgaagagcttgcctccgaattccagatagagtttgccgccgaattgcgcgatgcgctttctgatgttggcggcttgcagctcgatgtatttttcgttgtcgaatccctggcgcatagaggtcggcatccctttccgaacgacgtcgtaaacggaaaaattataccggacgtcgtcggcaacaaaaaatgggattccccgatggggaatcccattcgtcatagagagcaattactcccgaggaatgttgaacaggggtttgcatggctcccaaaaacgcgctggttgaaacgttgccgacgacgcgtgcgctcgaagagtatgcacgggtggctttgcggtgatttcccagaccgttcgttgctaggcgagatatttctttttccaggccttctttcgggcgtaagcgttttctgtcatgtcggagtagtcgtaatcaactttgaacttgccgttggaatggagaataagcgtcatcgatccccatctcttttcgggcttaagcgcggccctttcaggttcaatgaacttgttgatagccataaagtttttcatcaaggatgccctcgaaacgcctttttggtcaaagcatttaacgaagtcgtcttttccgctgccagcaacgtaatactcaatagagaacgcaccctcggcgtactcggcgtaaaacacgaccttgctccagtcttcggggagggtttcctcaagaattgaagctatcccttgtagcatcttcttttcactcattacatttcctttgcagtgttaagaagaaacgtaaccgtctcttcgccgtcaataatgtccgtgatagcaaacgagctaggcctgaatgacccgccctcataaagtggctcaaccttgaaaaacacttcagcgccatcagccaaagcatcggcgcatttttgctcgattgctgcataggctttttggttaacctcgccgcccatggcgacaatattctcaaggccatttgatccattgaatcggtcggcaatcagatggcctctttgatcaaaaagctcttcaaacccttttccgattgactggatagtgtccttgatggtcaaacgaccttcgtgggtctttagttgtaagaagccttcggccgattcgaccctacccattgcatcggtaacgtatttatacccattgatctcatagctcatgttcggaacgaggtcgtcgccaacgcggtaaagttgcccgagatcgtcggttgcacacttcacgccgtcgatcgcaaactcgttattgggaagcagtcggtcgccttcgtaaattgcctttccggcatcatccagaattcgtgagcttgcgcccgattctgctgcctttgaggcaagaaagttatttagacctcgtccggcaagaagcgttgctgccgtaacagttcccgcaacgacttctccgacgatatcctcctgagatatctcaccgtcttcagcgccggcttccaagctctttcccatttcgtcaagaacgagtacagacccagcagcgagtgctgcaggggcagaagcggtgacggctacggcaccaagcgcaacttcagtggcgatttcgcctccagtttcgacatagtctccgatttcccgtatctgctcatcggcttccatgaagtcgccccaggcgttggctgcatcgtcaacagcgtgtgtttgcgcggttttcaccgctgcttcttcgtcttcggccagtagttcaatattcgattcaacaccgacatatgcgttttctccaacgtcggcaactccaagtacgaacctgccgccaagataagctccgttccttgcgccatcgcggacagtttcgcctgcagcgttgagtgttggctcgcatgctttccaggcgtcatctgcggcttcttgaactgttgaaatgctcgcggttaggacatcgccggaagaaatatcccgccatgcggcatctgcacaatcagcaacggtgcgttgcgcctcctcgaaggccaatctcgtttcggtcgtatccggcattaattgctctatattttcaaacgccatttagatcaccggccttgtttgagataagaccgctgatacttcggcgagtgctgaggccttttccgttgtctcgatgccggtacccctctttctcagctcgttgagatgagcgttaagcatcgactgaatgaacaggtattggattggtccccagctttcgggtgaggagtcatcttcgaatttccagcttgaaagcagatgggagcaaagcctctctttgaggctgtcggcagataaatccctggcgtcgtcgaggatgcgtccaatattgaaatacctataagcacaccattcaaacagtggcttcctcgaggacagaggagtccttgccatctcaatcaagcgtgccttcatggagtcaggtatgtccatcttgtgcacacagtcgcagaagttgtattcccttggctcatcgagcttgaacggattaagcacacaagagttgagatagcgaagctcttcagaagaagccttgtccttcgcgctgtgcttgctctgtgtcggcgagtactctaggccgcgttcatgcggttcgatgtgacagaggacaggttcgatccattcgttctgatatattgctgcaacgcctcgctgaagctttgcaagctcttggatttggctctcgttaagatttgccgccttgccgataagcatcctgtcgccttcgtcaggcagtttccaggataagtcgatgcgatgattctgcctcaagcccagcgggttgttaaggcgcggtcattttggcgcttacatctcactttttgcagacgtagaatacgggtattggaatcataggagggttctcatgccaaatatcggtaaggacgaccatccgaagctgtggtcgcttattttcgtgcttatcatcgcgctgaccttctgttgcttcgtcatgggccaaggactcaacagtggaaccagcgtcttcctggcaggccaaggttacggtgcgagccttgccggcgtacttgcactcgtcttctccattgccgccgcgttagcacgactgttcgtcggccctgttatcgacaacggcaagtgctcactcgttatcatcgccggcatcgctatcctcatagcaggaacagcactgtccgctgtcgttcaaggcatccccctcttcacaatcagccgtttgctgcaaggcgtgggctttggcgcagcaacaacagcagcctcgaccgccgcagcaagcgtcttaccgcaagaacggctcggcgaaggcattggataccacggcctcggacaggctatcgccatgagcatcggcccagccttcgcactttacctagtaggaaccgatccctcaacgaacctctatgtcggccttgccctggttgggtttgcagggcttgtaatcgccctcaacgcacgctatgaaagtaaatggcaaactctgccaagctccagcgcataccgaatcaaaatggaaacccggctcgaactcgactcaaaagacgggcaggcaccccagccccaccacagtaactacatccgaaacaattaacagtgaaaagtatcctgaaggcgaccaggtgtccaagagaaccctgcgtgactcattcaacatcttcgagccgcgcgcattgcctggcgccatcccacagatgatcatgtgccccacttttggctttggcgtcttctttgctggtctgtacggtactactctcggctatacccacgccggtctcttctacaccatcagcgcggtaagcatgattatcattcgcatgatttcaaagcatttcatggacaccgtacctgcaatcaaaacaatgaccggagccgtcgcgtgcggcatcctctgctgccttatgctacttgccgcaccgtacggggaacctgtcttcctggcgtccggaatcttctatggtctcgccactggcataagcctgccacttaatcaaagcgtagcggtaaagaacaccccgccagagcgctggggcgccgcaaacgccctgttcctgctcgccaatgacatcggcattggcttcgcaagcgtaatctggggcgttatcaatgactcattcgggttccagacaagcatcgtctgcgtcattgtctgccttatcgcaagctacgcatccgcctggatcgtctaccccgcccgcgacaagcggtggaggcattagagcgtaagcgtcaaaatgaccgcgtagcaggaaacgtccaggaccattccggcatacggatggaaaagtcctggacgtttccatctttgcgttgcggtatgccttaggccgctatgtcgctacaggccctcctcggcgttgttcgccatctcgtcgtcgaacgcatcggggtcgatgttaattatgaagtcgtcaggcatctctttggccttctcggcagcggctgggtcgagcttgcaggactcaggcaccctatccgaccacggcaggaacgagtccacaacctcatcggtgagctcgccggcgttgggcatctcggtcagcagccactcgacgtaaagcctgggattgagcccgttggccttggccgtggtggtgacgctgtatatcgccgcagacgcccgcgcgccgcgcggcgcatcgctgaagagccagttcttgcgccctacgacgaagattcgctgggcctgctcggcgacgttgttcgagagctccaggtgccccgtcttcgagcacgttcatgacgtagggccagaactccacagcgtactgcagcgcacggtgcggcgccagcttcggcgaggctaggggaagctgggcccgcgcccatcccccgaagtcctccatgagcgggcggagctccgcgtcgcgggcggccttcctgccgcccggctccatgtcgtcgaacttggagtcgaccttgaacatggcgtcgatcctgcgccttgcctcgagcgcaacgctggccgcagacgccgccttggcgccgccgccggcgatcttcacgatttgggcgaagtagcggcgcacgtggacgaggcacgccgtgttggcgatgttggggttgccgagattgaagtagggtttgtagccgttggcggtaagcgtgccggaccagcccgcaagaaactcctgggcaacgcccttcctgcgggtctcgtggtattcgaatacatacacgggcacgttgcagcgcgccgagcagaacagccacatcctcgatttcttcttcgcctcgcggttcggctctttcaggacctgaaccgtggtctcatcggcatgaatcctgacatgcgacagcagctcgaccttcattctctcatggaccttcgccagccagcgcgcgcccgatgtctatttagaagtgcaacacccttgttggtcctgtaattctaacagttaacgtgaccatggaaggccgctcaaacctcaggtgttgcaaccaccactagaatccgcccgacagctcccctcagaaagggggggccaagattaccgcctattcagtgtcgatcacagctggccgacgaggtcgaggctgggctcgatggtttcctcgccaggggtccagttggcggggcagacctggtcgccgtgctcgtagacgaactgggaggcctgcacgcggcgcagcagctcctcggcgttgcggcccacgttggaggagatgacctcgtaggccacgaccttgccctccgggctcacgatgaagtcgccacgctcagccacgccatcggcctcgttgtaggtgtcgagatccttggccagcagggcggtcgggtcggcaagcatcgggtactcgatcttggcgatcttctcgttggcgtcgtgccaagccttgtgcacgaagtgggtgtcgcaggagacggagtagatctcgcaaccgatttccttgaacttggcgtagttctcggccaggtcttcaagctcggtggggcacacgaaggtgaagtcggccgggtagaagaagaacagggaccagtggccgagcacatcgtccttggtcacttcgtggaactcattgttctggaatgcgttcaccttgaaatcggtcagttcatgctgcagaagagtcatcatcggtcctttcgggaattgttaatcttcaagcgtttaccaccacctatcgtaatgtggtgagccacggctcgcgcgggtgtaacgtatgagccttatcacaccacccgcaacccttgtgcccaaatggccgttgccccaatcacgactatgcgcgaatactcgctaatatggcaatcagcagcccgctgataatggaggtttcatggctcagtcagactttgaacaggaatcgaccgcaaacgcaacgtggagtcgcatgctgcaaggcaaccggcgctttgccgagggcaagcccgaccatccatggcaggatcaggagacccgtcaaacgttgcttgatggccagaacccggatgccgcggtgctctcctgctcggactcgcgcgtacctccggaaatcatttttgatcagggcctgggcgacctgttcaccgtgcgcaccgccgggcaactcatcgatagcgcggttatcgcctcgctggagtacgcggtcaagaaactgcacgtcagcctgatctgtgtgctcggtcacgagcactgcggcgcaatcgaggccgccgagcaggagctggacgacctgatgcacaccatcacttccgaagccgacggctcactggaggccgcggatgcgatggacgacctcgacgagcacatcgcctccgccgaatcgattattctgcgccagaccggtatgtccgtctggcaggcgcgcgaagccgagctcgacgcgcatgaagatatcgagcgcgtgcatgtggcccacattattgaaactttggtggagcagtctcctgtcatccagcaggccctcgccactgacaagctcatgatcgtcggcgcccgctatcagctcgattccggcaaagtggaagtgctgagcttctgagcgtgcgatccgcaatatcgccacctgcgtgggatttggcgaatccttggccatagccgcgagaaacagcctctctgcactagtaatgccgtccagcgctggagcgcatacggcatcgtcgaaggcgagcaacgcatcggaaacaccggtcgacacgtcgtccgcggtaatgataagagtgcccttccctttgccgagtttcttactgcccagccagcacaccccaatttgacgtgccactcccctagagttgaagccatgtcacttggtttgaacatcctcctgatttttgtatttctcgttatcggttccgtgttctccggcaccgagttggcattggtctctctgcgcggctcgcagatcgagcaaatggagcaggaggacgctcgcggcgccaaagtcgccaaaatcgcacgtgacccgaacaccttcctgtccaccgtgcagatcggcgtgacgctctccggcttcctgtccgcctcgttcggcgcctcctccatcgccccctacctgattccggcggtcgaaagctggggcgtgcaccccggcatcgccggcggcctggtgaacatcatcctgaccctcatcatctcctactgttccatcgtgatctccgagatggtgcccaagcgcatcgccatgcagcgcaccgagcagatcgcgcgcgccgtggtgcccgccatcgacgccttcgccgccgtctgccgcccgatcatctggctcatcggcaagaacacgaacggcatcgtccgcctgctcggcttcgacccgcagcagaccgagtccgaggtgtccgacgacgagctgcgcgtgctggtcagctccaacaccaacctctccaaggacgaacgcacgattctggacgatgtgttcgacgcgtccgaaaccatcgtcgccgaggtgatgcgcccacgtgccgacgtggtcttcatcgagggcgaccagcccttggccgaggccgccgcgttcgtacgcgaccagccgtactcccgttacccggtgaccggcaaggatttcgacgacgtgatcggcttcgtgcatgtgcgcgatctgctggacgtgcgcgatccgaacgccaagatcgtgcgcgatgtggtgcgcgaaggcatctccctgcccggcacctccaagctgctgccaagcctggaactgctgcgtaagcgcggcatccatctggccgtggtcatcgacgagtacggcggcacggacggcatcgtgacgcttgaggatatgaccgaggagcttgtgggcgatattcgcgatgagtacgatctgcccagcgagaagggcggcgaacgcaccacccgcaccgcgttcgtcaatggcgtggccacgatcgaggccagcatgaccattgaggacttcgccgatctgaccggcatcgagctggaggacggcccgtacgagacggtcgccggctacttcctgtccaagaccggcaagatgggagcggtaggcgacgtgctgcattccgacgacggctacaacatggtcgtcaccaaggtggatggccgccgcatcgaaaccatcgaagtccgcaaagccggcgccccggaccatgcgccgctgccggccgaatcacaaagcgacgatgccaaatagtcgcgtgatattcaccacctattcgttcggcccggggcataaccaaaaaacgtagaatgaaagggcaacgttccacctactgaaagaaggaacattatgacacttgcatttgttgtgccgggccttgatgaagcggccagtgagaaggccatcgccatcctgcagaaccgactgagccaggagcaggaggccgctctggtcctgaagcacgcacactggaacgtgaccggcccgaacttcatcgccgttcacgagatgcttgaccccgaggtcgaggccgtgctggcccaggccgacgagaccgccgagcgcattgccactctgggcggcaccccggatggccgtgctgacgccatcgtgcgcaaccgcacgtggaaatcgttcgacgctgagggccgcgtgggcaccgaggagtatctcaaggcgctgatcgagtactacgacgccttcatcgccgacgaccgcaaggccatcgccgagctggacgagctggatgtgatcagctccaacatcatccaggaccacgtgcaggaactcgaaaagttccagtggttcatgcgctctcacctggcataagtaaaagccgtattccgtggctcccctcaaagaggggagccactttcgtctcacgtgaaatagagagtctccacatacataagttggaaaagtgtataaaactccccattttgaggttggaaaacgtagccaaaaccgcattcttatggttggaaaagtgtaaaatatgcgctataaacagttggaaaacgtgcccagcatagatgcaaggcctacaaatgactggagattctcatgctgcgaagaaaaatcgagacacagctggaagcttggagatccgcgccgaaacgcactgcactgctggtcaccggagcccgtcagattggcaaaacctatatcatcaggcactttgcccaacagcattacgaccatatcgccgagctcaatttcatcgagaaccctgacctcgttgcattattcgatcggccccgcgatgccaaaaacctactgatgaggctggaactggccgtaaatacgccattagtacccggcaaaaccctgattttctttgacgaggtccagcgttgcaaggaaatggtcaccgcaattaagttccttgtagatgatggtcggttcgattacgcgctttccggctcgctacttggagtcgagctcgaagatatacgctcggtaccggtcgggtacctgaccgagctggatatgtatccactggatttccaagagttctgctggtcgcagcatatcggcaacgacgtattcgatatgcttgccgaatgctttgccaagcaccaggaagtggatgagttcattcatcaaaggctcatggagctatactccaaatatctggtcatcggcggcatgcctgccgcagtcgactcgttcgtggcaaacggcagcgttgcggacgtgcgcactatacaagagaacataaagcgtgaatatcgccgcgatatcagccaatacgcgcgcaaagaagaccggctgcatatccgcgctatctacgatttggtgcccagcgagttaaataacccaaacaagcgctttaccttcgccaaaatcgaaaagaacatgagattccaatcggttgcttccgatttcgattggctggtcaatgcggatgtagccgtcgccgcgtacaacgtggacgaaccgtgcacaccgttggagatgagcaaggaacgtaacctcttcaaactcttttacaacgacgtgggtctgcttaccggctcgtttctcaagaaaaccgcgctcgacgtactcgacggcaaccctgatatcaactacggttcaatctatgaaaatgcggtggcccaagagctacgcgctcacggatttgacctgtactactacaacagtaagaagcttggcgagctcgatttcctcatccaagaccgcaacgatcacgtgctgccgattgaggtgaagtccggcaaatcctacaaacgccatcgcgcaatggacaacgtgctcgcccaccctgaataccatctcaatacaggctatgtgcttggcccgtgcaacgtctcagtcgaagggaatgtaacctacctgcctgtatacatggccggcatgttccataacgaatgacgggccgcacacttagtcaacaagtacatgtcggtcagatggttcggactggtcagagggcccgctctgatcagttaggtcggtctgaacggactggctgggctggtcggcctgagtagcccgtttggaccgatccggttcgcccttgctggccttcacactgcttcagctccagctgaagttcgctgatgcgccgttcgagttcgtcgatgcgccgcacgtgtggcgaagtgagactaaggggagccgagagatggctcacaggccgagggcaccggccacggccatggcctcgtgttcgggatcggcctggccgatgtgtacgttgacgtgaatttcgtcatcgcccggctcttcgagaatgtcggactgggattgcagcatgctcggcttcatgaagtggccttggcggtgggaaaggcgttccatcacctcgtcgaatgtgccctgcatgtagacgaacaccacgccttgacggcgcagcttgtcgcggtagatcttcttcaacgccgagcaggtgaccacggcgggctcgccggcggccacgcgctcgtcgatccacgcggcgatggtgtcgagccaaggccagcggtcttcgtcggtgagcgggtgtccggcggccatcgagatggtggcgcattcggaccatgcgaacgaatccgatcaggccatcagccacatcgccggcactgaagcctgacccgtcatcgtcacagcaccacgcggcggttgaggtcgcggcgcagcgtcttccagccgggtaggtaggcggtcatgcggcgctggaatccggcaccgtggccgctttcccacaaatgcgtcatctcatggaccaagacgtattccaggaattgcggttccatcagtcccaattgaaggttcagacggatgcggccggttcgcggtgtacacgatccccagcgcgaggtcatgacccgtagcgtgatatgcgtgggctgccggccgacgaccggcccccacttggccagcagctgtggcaacgcggcgttgatcgcggccgccgcttgtcgtttgcgttcgtcggtccagatttgggagcggtcaaaatacggttggacattcgtaccggcttggcctggcccggcgtcaccaattcccggacgactgatatcaccggttttcggacgaccggcaacgcctccatcatggccgctggcaccagctacaccacgacctccgttctcgaagccggcgccctcgttcagtgccatgatggagcgccgttgcgcctcagccatgcgctgctgctgggcgagaatccacgaatgtcgctctttgacgaaatccgcgatacgactctcgctcatccgcatcggtgcagagatttcgacgcggccgctcggcggtttgatgcgcaaatacaggtttttgatgggtttgcgcgtcaggtgcagatggatgccgtcaatgtccaacgactgcccggcggcagcggaccgaacggatttcggcgcaccggacttcggagcggtggattgacgacggcgataaggcatgcaagtcattctcgcacaacggcggacaacgatggcggcccgcccgaaacctaacgttccgaacgggccgccatcagcaatgaacggtgctgtcggcaacggctacaaaccgtcaccgagccattgagtcacccaatcagcaaccggccgcggtcagcacctggtcgaggatctcgacgccctgggtcgcctcgtcggcggagatgacgcaaggaggagtgacgtggatgcggttgttgtgcacgccgagaatcaggccgcgcttgtcgccttcggccacgatctgcttcatcgtggcgtcgtccagcggctccttggtggtgcggtcggcaaccatttccacggcccagaacacgcccttgccgcgaacctcgccgatcttcgggtgcttgtcgtacagagcggtgagctgcgggccgagcacgtccttgccgatggtgtaggcgttgtcgacgatgtgctcctcttccatggcttcctgagtggccacgatggcgcccatggccagcgggtgaccggagtaggtcaggccgccggggaagacgatgtcgtcgaagcggtgggccaccgggtcgctcataatcacgccgccggcgggcacgtaaccggagttgcagcccttggcgaaggagatgatgtccggcgtgtagtcgtagtcgtcgagtgcgaaccagaagccggtgcggccgaagccggccatgacctcgtcggtgatcatcaggatgctgtacttcttggtgatctcgcgcacgcccttgaagtagtccttgggcggaatgatgatgcctgcggtgcccggcacggattcgagcagcacggcggcgatggtgtccgggccctcgaactggatcacgtgctcgaggtgagccagcgcacgctcgcactcctcttcctgggtggttgcggagaactcggagcgatacaggtacggggtgaagaagtgcacgtggccgcgagagtagtcgttgggcttacggcgccagtcaccggtggcgctgatggccgcaccggtgttgccgtggtagcagcggtaggaagacagaatcttgtcgcggccagtgaacaggcgggcggcgcgcatcgcgttttcattggcgtcggcgccagcgttggtgaagaacaccttgtcgaagccttccggagcgcggcgggccaccagggaggcggcgcggccacgggctaggttcgcgtagtcaggtccgacggtgcacaggagttccgcttgcttcttgatgccctcgatcaccttcgggtgctggtagccgatgttgacgttgacctgctggctggtgaagtcgagcatttcacggccgtcgccgtacttcagccacacgccgtgaccggttaccactccagtgggatccaggttgcgctgtgcgtgccacgaatggaatacgtgtgcgcggtccagcttgtaagcgtcgtcccagatttccgcatcctgcgaaagatcatgccccatgatgtgtcctttcctcgatattttctcgaagtgcccgatgccgtctcccgtggatcgggtcagggcagcaacgcgctgtgaatgtcattatgagagttgaacatttcgcgtcaaactcgaacatttaataatgttacagtagtggcgaatacgaaatcattttgaaacataggaacaagaacaataattgtatccagattatgtaatgtttatgttattcaaaaacatactcattgcacaatgcggcgctaacatttgactaccgttgccacagtgaccgttactatcggcagtcaagcagccagcaacaagccggcaaccgccatcgatcatcagccggcggcaatcggcaacattcacgcagacgcgcgctcatcacgctcgccgccaagatccgggaggcagatcatggatacgccatcgccatcaaccgcatcaacaaccgcacatgccgtcggctacaacgatgagccaagcattacggccgctcccctgcgttccaccgacgacctggccgttgatgccggccagttatcctcactcatcctcaccaccgaggcgacggccaccccgcaacgcatcgtcgaatcggtcacctcgctgacctcctccggcatacttgcggaaggccagcgcatgcccaccgtacgcgatctcgcccgactgctacgcaccagtccggccaccgtctccagtgcctaccatgccctcgccaggtccggcatactgcgctcccgcgggcgcgccggaacattcgtactgcggcagtcgcgcacgcatcgctacgatgccggcgacttgctggccgaagccccggccaccgcgccggaccgaccgattatcgacctgtccaagggcacgccggacctttcgctgctgccggacatccgcccgtttctcggcaagctcggcacgcacaaggcattcgtcaattcatacgacgggccgaccatcctgcccatgctggaacagattttgcgacgcaactggccgtatgagccggaggcgatgactatggcatccggcgcgggcgacggtttggcgcacaccatgaacgcttttgttcagccgggtgattttgtgattaccgaggcaccggaatatccgctgattctcgacatgatcgaggcacatggcgcgatggcgttcggcgtgccgatggacgggttcggtatgctgcccgacgcactcgaccgtgcgctgaccatgctggaatcgcagcgtctggcggtgccgcacggcggccatcaggtcagtatgatcctgctgcagccgcgcgcccagaaccctaccggggccagcttcagcccgcaacgcatcgacgctttggcggacgtgctgctcgcgcactacccgaatggcgttggtatgccgctgattgtggaagacgatcacagtggcgatgtggccaatgcgtatgcgacatcgttggcgcaacgattgccgcaacacgtggtgcatatccgcagtttttcgaagtcgcacgggccggatctgcgcttggctgcgctgtctgggccggaggatgccgtggaggcgattatcgcccaacgacgcttgggatcgggatgggtgagccggttcctgcaagagattctgtatgaaatgctggccgacaaagaggcgttccacacggtgaccaacgcccggcatatctacgccacccggcaaaagacgatgcacgcgctgctgctgcgtcaaagtttggacgtgcataccggtgacggactgaatctgtggattccggtgcgcgacgagccggcggcgctgcgactgctggccgaacagggcatccgtgtggccgccggcaagccgttcctgccgagcctgcgtatcagcgccgacgccaccggagccgacgcgggggccggtgcgggcgtggacgcgcatgccagtcgaggcatccgcgtcaccatcgcacagcagggagccgtcaacgaacaagtggccgccgccctggctcaggcggcggccgtaacgccgaagacttcgacgaatcactcgtaattcttcatgaactgcgttcgtacgcgcggcgaggagccgcccgtctgtacggggtgatcaacgggctgctgcgcatgcgcaacgggctgcgcaggtcgcaggagctcgacgacctggtcgacgtgctggcctcctccatcggcgccctgaccaatccgcgtaccaactgcccacaccggagaaggtcgcgcaggagaagcctcgctgctcgagatcgacgacagcttccagaagatcgtcctcgtacgcgacgtggtcaaacccgtccgcgacgagcacggcatcctcacgatgagcgtctacgatttcctcctcgacccggacagcctgacgatgtgacgccgtggattggctacaacgtattagacagtccgatgagggacgaatgacatgagattggaggccgacgatggccgacccgaaacatccccgccactacgacgaggcgttcaaacggcagatcgtgcagttgtacgagagcggcaagccatcccggaagatccgccgtcgtggcccgacatcctcaggaccatcgagctgggctactccaacgccaggctcgaggcgtccgacaacaggatcaaggtcaccatccgcatggcctacggcttccaccacgcgaacagcctcatcgcactcgtcatgctccgctgcgccggcaatcatggcgcaagcgacaatcgcgacacgccgttattgacataccgccgttcaatggtattgtaatcacttgtgcgcttttgaagcgtatggatcgggcccgtagctcagctggttagagcgcatccctgataaggatgaggtcggaggttcaagtcctcccgggcccacaggaaaaatgaagcggccgcgagccgctctttttttctcacggggctatagcgcagctggtagcgcatctgctttgcaagcagagggtcgccggttcgaacccggctagctccacagacacaacaaaacccttggaatcagtccgattccaagggtttttgttcttgcattttctgcgtattgcaacaaaaagatgacgacacgccgatagcgtatctcacgagaaaagtcttattgcctcacgactgtcgaggccaccggaagtcggcataggcattccaatcggccactaaatcgaccgatgcccgatccctgagccaaacggacccgaatgccgttcatcatcgacaaagcagtccgcgcctcgcgacgaggatctgccaaaccgtcacgctcgactgctcgggttaaggtgtccatcacgcgatgttctcgtttttggtaatactcataggcaggatgatgctcgttcaacgattcgccttgtagcacggtatatacaaccgcaccatctctggctgagccgcattgcgctccataagggcagcacagatatcacgaatgccgaactgcgcgttgccgctccacatatcctcaggttcaacgccaagagaatgggcaaacgtagccatgtcttcccgatcacgatgctccagcacggcaatcagcaagccgactttgttcttgaaatggtatatgaccgccggctcggtcaatccgcatgcttcggctacctgacgaacggaaaagccccaaaacccgttctgtgaatcacatgcgacgtcacgtcgatgatctgttcacggcgttccgcacattctgattctgctcaagacagatccagctcgttgttgtccttggctttgctcaccgtatcagtcaaatcggggtcgtccacagacaccgcgttctgctggctgagcgtcaacgacagcgaacctttgtaggagtcgccgtattcgtccttgccggacacgcttacggcaatcgagctcatcagatgcttcctgccgtagttcagatccacggtgatagtcggcatatccggctcttcatccgtgccgaagtcccagttgcgcacattgtcgagcgcctgacggtactcgccttcagcatcgcccacaccggtatcctcgatctgctgaatcacccatgatttcagatgcggatactgcgcttcatggctgatccagtaattcacaaagtgctgggccaatgccttgacatcgatttgatacgagagctgcgtgttgccggcagacttggcagacgatgtattcgggaacagctggctgcgcacattcttatcttccagctccacgccgagatattgttggatgaatttgctggcctcggccttcacctcggcagacgttttcgtgcccttggcccggtcgatgtcgttcgagtacccatcgtcgttcatcttgtccagctgatcgtagaacgttcgctccgcgccggtgatgtcccaagcaccgttcttgaccaacgcatccttgacgttcaatatcaagtccgccacatcactaccaacgccgttccttaagtcatcttcatattggtcggccgggtagtagatgtagtaggggtcgtcatcataccaaacgtttttcccggcgaatgcgcctttgtgccaagcgagggttgttgcctgttcatctgtcttgatggtcacagacgcggaggagtcattggtggttttgccccagcgaatacatgccagacatccgcgcgtcaagggagtcgtcagtgctgctgtgggttctgagttcgtatttggtgctgcgcagagtggacagcgagttgatcgcgtcgaaggtgacgaccagcggattggtgggctggaagcccagcatcgctttgacggcggtgaagttggggacgatgaatgccaaggccgccaccagaatcgtcgcaagcaatgcgcagagaacggcgatcagcttcttgctggatttgcgcggcggtgccaggacggcggttgcatcagtcgcctgatatgcggcaggagcgggaatcggcaaagctggcaagggagcagttggtgccggctgtggggcagcgggcgcggcgtaaaccgatggggcaaccggcgcggctggtatcgatggtggtactgaaggcgctggcacagcaggtgccggtatcgacgcagtcggtacggctgacgatgcggccggcactggtacagacgcaaccggtgcgctgtctacagacgctccacatgccgggcaaaatcgtgccggcctatcaactctatttccgcagtggccgcagtacgccatcgtgtgcttctcttcctcaaatcggcttgattgccattgcttcaatgttactcttcagcattacgcctcagccagcccctacgcgtaacgatacgagacgcggcagccttaatgcggttgttttgacgcgatgccaacatcgagctctggccaacgttctggtactcggctacatcttgctgcgagccaagaagcaggccatcgctcgcgccgacgaggccgaatggcggcctagcctcgctttaagcctcaggccagcacctccatggggtgataggtggcggtgtggtggccggtgatggggttccatacccgttcggcgaatgcgcgcagacgggcgacgccctcacgcagctcgccggcatctccggcgtaggagaggcgcacgaagccgcgcccctcctcgccgaaggcctcgccggggaccacggccacgtgctcttcgtccagcagacggtctgcgaattcaccggagtcaaggccagtcaggcgtacgtccacaaaggcgtagaacgcaccttgcggttcaatcaagcgcaataccgggcatccggccagaccgtccagcacgatctggcgcttggcgcggtattcctcgcgcatggcggccacatgatcctgcggaccggccagtgctgccacgcctgcgtattgcgccaaggagttcaccgaggagtgcatgagttcggcgattttaccggtctgttcgatgaccgcttcgggtgccagcaggtagccgatgcgccagccggtcatcgcgtaggttttcgacaggctttccaccacaatggtgcggtctttcatgcccggcaccgcggcaatcgatggtgccacggctgcctctcccccaagcgtttccccgaacgtttccccaaacacgaacggatggtaaacctcgtcggagatggcccaaatattgtgctgcttgcatacttcggcaatacgcgccagttcagcggcagaagttaccgcgccggtcggattgccgggtgagttgatgattacggcgcgggtgcgcggggtgatcgccgcttcgatgtccgccgcgttcacgcgcatgccgtgctccggacgcagcgccacggtgaccgggcggccgccgcacagcatcacttcggcgtcataggaagtgaagaacggcgagggaataatcacttcatcgccggtgcctaccacggctttcagcgccagaaacaggccaatcgtggcaccgtcaacggcttgaatctcggtttcgggatcataagtgagtcccttcacacgggcggagtaatcggccacggccttgcggtattcggggacgccgagcacgttggtgtaccgagtgcggccagcctgtgcggcctcgcaagcggccgccacgatatgcggcgcggccgtggcgctgggctcccccacggtcagtgaaatcgcgtcaggcacgcgctctacacggtcgaatacgtctcggatgccggagcgcgggatattcagggcttcggcggacaagctcgcgggcttggcggtcggcacagcaacccgtctgacagcaggcacagcagcagatgcaacttcggacagaggcatgttggaaaacttctgcatatcatccctcctcaatggaattatttcgtcgttctcttatttcagaaggaattattacattcaattaggactttaggcataaacattccaccacacaacagaaaacacaggaagaactactgaaattaccaggcaaaatcggaaagccatcgcattccggcaacaggtacagtgaacacagagcacaacgaacggagaagacaccatgaccgcgattgacgagaccgaccagcgcatcctcaccatgctggaggccgacggccgcgccacgctcgcgcaactggcccaggcgaccggactgtccgtctccgccgcccagtcgcgcgtgcagaagctggagaagcgcggcatcatcaagggatacaaggccatcatcgaccaagagcagcgcggcttgcccatcagcgcgttcgtcaacgtgaccccgctcgactactcagccgaatcctcgattccggacaagctgaacaatatcgacggcatcgtctcctgctattcggtggccggcgcccccagcttcgtactggtggtacgcgtggcctcccccaccgcccttgaggaattgctcaatctcatccaccgcacggtgccggtaagcaccgagaccacgatgattctgcagacctacttcgcgcactgaccgcgaacccggtaacctgcgcgccgaagacctcggcccctacggcgcacgattcccaacgggcacatccgacatcacccaagtccacctttatgtccactatatgaacgcaccttcggtgtgatgcagcttccatttcgacccgattcacgcacagacagacatccagcaatcgccgaaaaatctaacaaacggaaacttgaaccaccccataaccacgccgatagctttcccgttatccgagcgagaccccgatgtctatttagaagtgcaacacccttgttggtcctgtaattctaacagttttgacggtcgtaccgacgtcgccgaggaggctgccaagctcttggcgaccatcgaccccgccgacgatgtgatcgtgtgcaccgacctgtttggcggcagcgtcaacaacgagttcaccaagatcgtccagacgcgtcccaacacctacctgatcgccaatatgaacctgccgctgctgatccagctgctgttctccgaccaggaggcgcccgccgaccaggtcatccgcgagatcctcgctgccgacgatacgcgcgtcaagtttgtcaacgacctgctgaccgatacggatgacgaggaagagttctagtcaccgtcttgcttttaacagcgccgggtttccggcatgagacctttgggggtcaatcatgattcaactgcttcgcgtcgaccatcgtctgcttcatggccaggtggccgtctcttgggttcagggcctgggctccgactgtatcttctgcgtcggtgataaggtcgccaacgatcccgtctggaagaccacgctcaagatgggcaagcctgccaacgccaagctcgtcatcaaggatatggagcacgccatcgaggccatcaactccggcgtgaccgataagtacaagatgatcatctgtgtcgccagcattgccgaggccaagcaacttgccgacggctgcccgcagatcacctccatcaacctgggcaacaccaagtccaaggatgagcagcgccccgatgcccgcaagatctcccgccagatctttgtgaccgcnnnnnnnnnnnnnnnnnnnnnnnnnnnnnnnnnnnnnnnnnnnnnnctcgccggccgcggtatcgaggtcgagattcgcgctctggccgacgaccccaaggtcgacgccgtaagcgccctctaattggggaccacggggcggcgtgcacggcgccgccccatcggcgggcgtaccggctaaacgttttatccgatagcccgcctaccgttcaccgggagtacctgcccgttgagcgattggtattaaatagtttccgcatgactatataattggtatgaaatcatttgtaccggtttaggtgttagcagcacaccggtacaagctggatctgggtagcgattgtcggcatggaaaagggcgcgctgacaagtcggtaatcgccgcgcagatccaagagggatcaaagggaggaacaatgcttgttcaagcgatcctcatcggacttatcgctgccttcggtaagctcgattatcagctcggtacgctctatgcgttccgtccgatcgtcctgtgcccgctcgtgggcatagtgctcggagacctgcagtccggccttgccatcggcgcgagcctcgagctgctcttcatgggttctatcgccatcggcgcctacgtgccgcccgatgagacgatcggcggcgtgctcgcctgcgccttcgctattcagctgggccagagcaccgaggccgctatcgcgctcgcgatgcccatcgccaccctgtgcctggccatcaagaacgtcgtcaacgccggtatgccccttctggtcgaccgcgccgacgtctttgccagcaagggtaacctcaagggcatctacgccatgcactggatcatcggcctcgtgatcgtcgccctggccttcttcctgtgctccgtctccttctatctgggtgccgacgccgttcagggcctgctcgacttcatcccgacgtttgtcctcgatggctttggcgtcgcagccaacatcctgcccgccatgggcttcgcaatgctcggccgtctggtgcttaccaagcagctcgtgccgttctacttcctgggcttcctgctgtgctcctatgccaacgtgcccgtcctcggtgtcgccctgatcgcaatcatcatcggcatcgacaagttcgacctgctgggccttggtggcgcccagccccagctttctgtggaaggggatgaggacgatgacttctaattccgagaaccagattactcgctccgacctcattaagagctctctgaacaccggcgctctgggcatggagttctcctggacctactacaagcagatgaatattgccttctgcctgatggtcgccaacatgctcaagaagatctacgccggccgtcccgacgactacgccgaggccctgcatcgccacagcgcgttcttcaacatcaccccgcagctcgctcccttcgtgggcggcatcgcgatggccatggaggagaaggtcgctcgcggtgaggttgagcccgagagcgtcaacgacatcaaggccgccctcatgggccctctttccggtctgggcgactccttcttcctgtccaccctgcgcgtcgtcgccgctgccgtgggcatcagcctgtgccaggccggcaatgcctttggtcccatcgcctttttgctcatctacaacatcccggcgttcctgattcgtatctttggcgccatcaagggttatgagctgggtatcggcttcctcgacgaggctcagaagaccggcctgatgcaaaagatcatggcttgcgtcggcatcgtcggcgtcatggtcgtcggcgccatgagcaaggacatgttctgggcctcgatgcctatcgccatcggccagggcgactccgcccagaccctccaggacatcctggatggcatcatgcccggcatgctcggcatggccgccttctggctttactattggctgctttccaagaagatcaacccgatggtcctgatcctctgcaccatggtcgtgggcattatcggcgtctactttggcgtgcttgcctaatatgtttacatcgcgcttccatcgcgtctaacggtagcgtcgatctttgggggcttgtcgcaggtgcggcggccccctgttttttcaagcctgtacgaaaggggagggctatggacgtacccgagctttcgctcatgaacatcaaccatcgttattacagcatcgagacgttcttcaaggcggccagcgaggcgggctatcgcaatatcgagctgtggaccggctcgatgcacctgtatgtggattgccatgagcacgattcggtggacaagattcgcgacctggccgctcagtacggcatcaagatcgtgtgcgtctgccccgagcagaacaaccccaagccgtggaacgtcgcggtgcgtggcgaggccggccagaagcgtatcctgtcctactttaagaacgtgatcgatgtcgccgtcgagcttggtgcgccgcagattttggtgacgagcggctgggcctatctggatgagccggccgaggatgcctgggcccgcagcgttgccatgctacgttcggtgtgcgattacgccgattcgcgcggcattcgtgtcgcactcgaggcactgcagccgtcggagtccgtgctggttaacaccgcacaggacgtggcgcgcatcttggccgatgtcgaccgccccaacctgaaggcctgcatcgactttggtgccatggaggttgccggcgacacgatcgacagctattttgaggttttgggcgacaagatcgttcacacccattttgtggatgtgggcggcggtacgacgcaccttgcctggggcgacggcgagcgcgatatgcgcgccgacctcgaggcgctcatgcgtcacggctatacgggctatgcctcagccgagacttgcgacggtcgctactatcgggacccgtccaaggcgacgactcaggttatcgagatgtatcgccgcgtgacggcagagatggaagccgaataactaagctgtgcggttgcgccggaaacgctggggcgggttcggcgcaacgtgcttttgggcgttgagttgtggagcgtctgtcggctgcggtactcgaattagacaacttatggtgttgtaataccactcgggtggggaaatcgaccgttcgccgcaaatcttcgtgagtttggattggtattaaataacgcgcaaacgtatggctataattggtatcagcaagacgcgcgatgtatagaatcgcgcacatgtgatgggaggacacacatgaaggagaccgagaagatcgagatcgtgcacttcgaccaggagggctacctcgaggacggcaggaacgtctacgaggccggcaagaggatgaccgccctggccgaccgcgtgcacgaggagggctacgacgccgtcttcctgatgggcgtcggcggcacctgggacgagttcatgcagctcgagtacctcatgaacaagttcggcgaccgcgacctcgaggtctacctgatccacgccgccgagtggaacgtcatgggccacaagcgcatgaccgagcgctccgtcgtgctgaccgcctccgagtccggcaccacccccgaggtcctcgaggccatcggcaagatgaaggagatgggcgtgcgcgtctacgccatgaccaacccggagggcaagatcgggcgggccgtgggcgccgagaactgcgtcatgatggcctccgaccacggcgccggcggctgcgagaagggctactacctcgccgactgcttcggcctgcgcctgctcaaccgccgcggctgcttccccaagttcgacctgttcatcgagcagacccgcgacgtctggaaggacatgctcgacatccgcaagcgcttcgagccgcgcgccgaggagctcgcgaggaagtacgccctggccgactacaccatgttcatcggctcgggcgccctgtggggcgagaccatcctgtactccatgtgcctgctcgaggagatgcagtggaagcgcatccgccacatcacctcgcacgacttcttccacggcaccctcgagctgctcgagcccggcgtcccggtgttcctgttcatgggcgaggacgagtgccgcgccctggacgagcgcgtccgcgccttcctcaccagcggcgtgaccggcgacgaggactacgtcatcatcgacaccgccgagtacgcgatcccgggcctggacgacgacttccgcgtcatcgtgtccccctggatcctgtcggtgctcaccaccgaccgcctctcgcgcaactacgagctggtcaccaagcacaacctcaagtaccgccgctactaccaccagttcgactactaagagctggtcgtaggtccgatatcttggctggttgatatctcgaccctacacaagggcgtccgtgttcgcgcgggcgccctttttgcgttggggcatgccggccgctagtgcgagtggctctgcggggctggtcgggaaagcgtgtcccggaattagcgcccagagtgggatgcggtttccggtagaagccttagcggaaagcttgttccggaattagggcctggaatgggatgccgtttcccgttgggatgggtttgggaaagcgtgtcccattctggaggctcattccgggatgcattttcccgatggggtgggtttcggaaagtgtgtcccgttctgagcgtctattctgggatgcggtttcccgttgaggcttcaagcggaaagcgtgtcccggaatggccgctcgaaatgggatgtgctttccccaatgtttccaaatgaatacgctgtgagccgtgggagacgattctccccgcaagcactctagtatgctaaagtacccagaagaccggcggagctatgccggtcttctgttctatacgaagcacagcatgaggaggctcaccagatgacggccacaccgtggggattccgggacatattgcccgaggaggctcaggcgcgcgaggagattgcgctgacggtgaagggctgctttagggagcatcattaccttccggtcgagacgccgctgctcgaggacaagggttcgcttgaggagggcggccgcatcgcggatacgccgttcaagctctttgacgacgatggtcgcctgctggtggttcgtcccgacaacacgctgccgatcgtgcgcctggtctcgacccgcatgcgcgcggccgacctgccactgcgcctgcgctacgaggcgccggtggttcgtgagtgccaacgcaatgccggcggttcgcgtcagtttacgcagttgggctttgagctcattggcgcgggtgacaccgcgggcgacgtggagattgtctcgctggtagcggaggccgtgcgcaaactcgcgctgcccgatgcgcacattatcgcaggcagcgtgcgtccgtttaaggagctgctcgcggcatgcgaagatcgcgagctggctgtcgaggcgctgcgctgcgtgcacgccaacgactttgtgggcctcgatgcccgcgtggcggaaagcgccgagcccgaggccgtcaaggccgcgcctgcatggcggtgccgaggtgctcgaccgcgtggacgcgctgctggcagcggccggtatcgtcgcgccgttgacgcgcgagctgcgtgccctggttgagggcctggctcccgaggatgcacaggtgctgtccttcgacttctccatcatgaattctttcgattactacacgggcctggtctttaaggcctatgccggtggcctgcccgatccggtgggttcgggcggtcgctacgactccatctttaccggcgcgttcggcgacggcatcgaggtgccggcggcgggctttgccttttcgctcgagcgcctggaggccgcgcacacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcccgctgcgcatcgccgtgcccaagggttcgctcaaggccgataccctcgacgtgctcgaggccgcgggtttggatgtctctgagctgcgcgatcccggtcgccacctgatcgtgcgcggtcgcgacacgcgtgccgacgagggcgcggtcggcgatattgagtttgtcatcgtgcgtcccagcgacgcgcccgcctttgtgggttgcggcggcgccgactgcggcatctgcggttgggattcgctcatcgaggccgacctcaacctgctgcagctggtcgatctgggctacggcctgtgcacctttattgaggcggagcccgcatggcgcgccggccaggctgagcgcaactatgcccgtcgtggttctctgcgcgtagccaccaagtacccgcgcatcgcgagcgcttggtatgccgagcgcggcgtgaatgccgatatcgtctccctgcacggcaatattgagttgggccccatcgtcggcatgaccgaccgtatcgtggacatcaccgccacgggtgcgaccttgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgcgtaacctggccgaccgcctggcggctgccgtgaaggacaagcattttgagcccgtcgcgggctcggcacaatagcgcgagcgcgcgcgggcgcccccacgtccgggctgcgggtcgattgtcgccaccgcccggcttctcgtttctcaaacgcaacctaaccgataggggataccgatatgaagaccatcaaacttgctcccggtgagcgcctcgttactaaccagctcaaccgcaagggcgtgctgccgcaaaacatcgtcgacgccgcccgcgatatcgtggccaacgtgcgcgccaacggcgatgtcgcagtgcgcgattattgccagcgttttgacggcgttgagctgcagagtttccgccttccgcagnnnnnnnnnnnnnnnnnnnnnnnnnnnnnnnnnnnnnnnnnnnnnnnnnnnnnnnnnnnnnnnnnnnnnnnnnnnnnnnnnnngagctggtttaccacgcgcccggacggcacgatgctcggcgtcaaggtgaccccgctcgcagctgccggcatctatgtgccgggcggccgtgcgcagtatccctccaccgtgctcatgaacgccattccggccaaggtggccggcgttaaacgcgtggtcatggtgaccccgccgcaaaaggatggcctgatcagcccgtatacgctcgcggctgccaagctcggcggcgtggacgagatctatatggtgggtggcgcccaggctgtcgctgcgctggcgtacggcaccgagagcattccgcgtgtcgannnnnnnnnntaagatcaccggcccgggcaacgcctttgtcgccgcggccaagcagatcgtgtcgggcgacgtgggcatcgacatggtcgccggcccgtccgaggtctgcgtgctggccgatgccacggccaagcccatggtggtcgcggccgacctgatggctcaggccgagcacgatccgctggccgcctgctatctggtgacctgcgacgagcagtttgcgcgcgaggtcgaggcgggtatcgatattctggtggcgcagtcgccgcgcgccgagatcacgcgtgcctcgctcgataacgagggcaccatcgtggtggccgccgacatggccgccgccgtcgaggccgtgaacaccgtggcgcccgagcacttggagctgcactgcaaggacgcgctgggcctgctcggaggcattcgcaacgctggcgccatctttgtgggcgcctggagctccgagccgctcggcgattacgtcgccggccccaaccacacgctgccgaccggcggcacggccatgttctnnnnnnnnnnattcaggcctacacggctttcggtggaggagttcgtcaaacgctcgagcgttatctgctatacgcccgagggcctgctttccgacgctcccgctacgcagcgcctggctgaggccgagggcctgtgggcacacgcactttcggccgcactgcgccgtcgcgtgctggagcagggcgaggactccgtgagtgccgagtcgctggccgcggccgacctgaccaaggtcgcctggccgggcgatacgatcgcgactgttgccgagggcgtggacctggcggcggctgcgagcagtgccgccggtgcggccggcgaggaggcctaacatggccgagctttcaccccgcatgaaggagctcgtccagccttacctggccggtattgagccctatgatcccaactttacgcccacgcgcatcaacctttcggccaacgagaacacctatcccgtgccggcaggtgtacgcgaggcggtcgatgcggcccttgccgccacgccgctcaaccgctatcccgatcccatgtctaacgacctgcgcgacgagcttgctgtctggcatggcgtgacgcgcgagaacatctgcgtgggcaacggtggcgacgagctgctctataactacctgctggcgtttggcggcgcggggcggaccctgctcaactgcccgccgtgctttagcgagtacgccttctttgcatcgctgtgccagaccgaggtgcgcgacgtgtggnnnnnnnnnncgacggcgcgaccgaggccctgtcggcaacattcatggctatgctcaaccccggcgacgaggtcatcatccccacgccggcctttggcctgtacgagagcaccgtcgtggccaatcacgccaaagcggtctttttggatacggagcccgcgcaatttcagattgacgaggaagcgcttcgcgcctgcgtgaccccggcgaccaaggccatcgttatctgctcgcccaacaatcccacgggcgatgtggcgccactcgactttgtcgcggcgctgtgcgatgcctgccctggcatggtgatggtcgacgaggcctacgttgagtttgccgacgattcgtttggcacggcaaccacggcgcaaggccttatcgccgagcatcccaacctggtgattttgcatacgctgtccaaggcgtttggcgccgccggcacgcgtctgggctatgtgatcgcggcgcccgaggtcatcgatgtgttcgcggcgattcgccagatctattcggtcaacgtgctgagccaggccgcagcgcttgcctgcgtgcgtgcccgcgatgcatacgcgcccgtggtggcgcaggttgcatccgagcgcgagcgcgagctgtgcgccctacgcgcaatggctgccgagggcctgcccgtggaggtatggccgagcgcggcaaattttgtgctcgcgcgcacgccgcatgccacgcgcgtgcgcgagcgtctgcgcgacgagtattcaattttggtgcgcgactttagctacgcgccggggctcgcggactgcctgcgcattaccgtgggcaccccgcaggaaaacgacgaggtgctggccgcgtttgccgcgctggtgaaggaggagatgtagatggaccgctatgccgaggtaacccgcaagacgggcgagaccgacattgtcgtcaagctcgacctggatggatccggtgtgtgcgatatctcgaccggcgtaccgtttttcgaccacatgctcaacgcctttggccgccatggcctgttcgatctgacggtgcacgcggtgggcgacgtggaggtcgatgcgcaccacaccgtcgaggacacgggtattgtgctgggcgaggcgttttgccaggctctgggcgacaaggcgggcattacacgctttgccgacgcggcgatcgccatggacgagacgctagtgatggctgctgttgatatttcgggccgcgggcaggcctactgcgagctgcccgtgccgaccgagcgcgtgggcagcttcgataccgagctggcggtcgagttcttctacgcctttgcgcgcgacgccaaactcacgctgcatgtgcgcgagctggcgggcggcaactcgcatcacattatcgaggccgcctttaaggccgagggccgcacgatgcgccacgcctgcgagctcgatccccgcgtgcaggtcggaatatgtgcagaagcggggagcgaacccacttttcgcaagagaccggggcataataggtggttggtcattgcatagatatgcaagttggctcagacattttgggaattggtatgagcaggcatagggcagggcacgcagtaagtattccgagcagaaggcaccgtgtctggccatgggtggtgtcgattctggcattgctcgtggtgctgttaggcgtgtgtggattctgcggattgaaaccgtattccgaagccaagcaggttaaggctcatgaggagcaggctttgcaattgttgggtggcatatccgatctcagcaatctcgacaacgttgataaggtgagttagcagatcgatcaagcgaagaccgaaaccgccgcggcgaacgatattgtgcatggcacgctgtggaacattgcctcgaaactgccagtgtatggcgatgacattaccgccgtgcagggcatgacttcggtagtggattcattgattggcgactcggcgccgcagtttatgaatgtgctgactactttgaagaatgcgcaactgagcacaggggatgggcagctgaatattcagccgattctggaggcgcagaagaccattgtctcagccaatgaatcgctgcaacagcaggtccagaaatatcagaatctgccgaaggcccatatcggcatagtcaacgatgcctacaacaccggcaagactcaattaacgaaattggccgatagggttgatcagctatctggcacattccagattccgccgaattttctcggctctggccaggcgcgtacatacgcgttgatggccatgaccacttcggaggagcgctcatccggtggcctgattggttccgtgggtgtggtgactacggacaacggcaagattagtattggggatttccgctcgaacaaagagtgcatcccgtatggtgctggtgatccaacggaagatgaacagcgtattttcgagcagtgggggcctctgaaaatgtcgttcgatatccgtgatttggctgtatatcctgatacctctcgtgttgcagaaggtatgcagtctatctggcagcgcacatcatggggacgtgacactccattggatggtgtgctcatggttgatccggtgtttctgcaggaattggtgaaaatcaacggcaacatcacgctttctgatggccgtgtgctcgccggaggcaacactgctgaattcctgttaaacaaggtgtatatcgattatccggtttacatgcaggacacctattttgcccaagtcgccgagcaaacagttagtaacatgttctctaatttggatttgacgaagctgagcaaggtagcgcaactgatgggaagtatgtcggaaggtcgttgcttctcaatgtattcgtttgacgaggctactgagaagactattagcgatgcaggcttcactgcacagactccgagcagtgaggaacatccgcaggcgggtgtgtatgtgactgagcagaacccgtcaaagatggggtggtatattcaccgcacgtcgaagataactcgttccgcctgcaataatgatggttctcagacctaccatgtggaatatacgatgacgaatacgatagacgataaccagattggcatagctggagctgccggaacgtatattctcagtgtaaacgctgatcaacaaggccgtggcgtagagaaaaccttaatctacgctcctgcgggaggcagcctcacgaatcttcaaacctcaggtggtacggtgactggtagtcgtcaggagactttgaatggcaagaccgtgtatgccagcatcgccaatatcggccctggagaatccgttacctactcctttgatgtgactacctctatcaaggccgtctccgacctcaccatcgaccaaactccaatgggctggactgattccggtgtcaccactgacaccgctgcctgttccatcaacaagcagtaaaaactgagctctctctgtgagggagctgtcagtcgcgctgactgagggagggatcaaaaaacggcgctgttgttgttttcgtgggtggtggttcgttgttgaaccgttgtgggagtaagagaagagcgctttttgggtaggctgtttaacgaccaagaaaagcacagccaaaaagcgcctgatgagcagcatattcaaccagcttctcaacgtcaaaggcacggtggtcgaggacgtgcggatcgtcgactcgccgttgcgtcccgagcccgtgctcgaggtccgcgtgcgcccgcgtgcgggcgcgctcagatgctcccgctgcggaaggaggcaccgcgggtatgaccagggcggcggagtgcgccgctggcgtggccaggacttcgggctgctggcgcgtcgaactggtcgccgccatgccgcgcgtggactgcccgaggtgcggcgtcgtggtcgcctccgtgccgtgggcggaaccgggcagccggttcaccagggatttcgagtgttttgcttcaatgtttgttcgacaggttcggcagtgtttttccgcagtgtgggctgatggttttccccggtgtcgtcatcgtttcccggtgatgtgagaggcatcggtgccgccgcctgtatattcccgagttgccaatcggttttgattcggccggttgccgccggccggcgctcgggaaggaaaggaacatggcgataccgatgcccattgtgcaagatatcaggagactcgaccggcagggaatgtcgcgcgcgcagatagcgcggcgtcttcacgtggatcgcgggacggtcgcgaagtacgcggatatggaggattgctcgcccaagccgaaggcggatcgcaggtacgggtcgaagatcgacccgtacgcgcatctggtggacgagtggctggaggccgatcgtctgctgcccaggaagcagcggcacacgatcaggcgcgtgcacgaccgtctgctggcggagacggactacgacggcgagtattcgaccacgatgcgttacgtgcaccggtggcgcgaggcgaaccgcggcgtgccggatcgcgaggggtacgtgcggctcgagtgggcggcgggcagcatgcaggtcgatttcggcgtggcccgggcccggatcgctggcgagatggcggacgtgcattgcctggtggtctcgttgccgtattcgaacatgcggttgtgcgtggcgttgccgggcgagaacgcggagtgtctgtgccatggtttgatgctcgtgttcgagcatatcgggggtgttcctcccgtgatcgtgatggacaacgcgaccggtgccggccggcgcaacgcgaagggcgaggtcgcgttgaccgggggtgttcctcccgtgatcgtgatggacaacgcgaccggtgccggccggcgcaacgcgaagggcgaggtcgcgttgaccgggggtgttcctcccgtgatcgtgatggacaacgcgaccggtgccggccggcgcaacgcgaagggcgaggtcgcgttgaccgggggtgttctccgcgttcgtggcgcattaccggctcgaggtccggttctgcaacccgtactcgggcaacgagaagggcagcgtggagaacgcggtcgggtttttgcggcgcaatctcatggtgccgcccatgcgcgcggaatcgtatgggcagttgagccgtctcctgctggagcggtgcgacgggctcgccagggactcgtgttgcccgaggttgccggacgtgcccgtggccgaggtgttcgacgaggagagggccgcgttgatgccgttgccgtccacggcgttcgacccggttcgctgggaaagccggacggccgacaagtacgggctggtcgacatcgactcgaaccggtacctcgccggccccgattcggcgcgttccagggtattggccgcgatccggtgggacacggtcacgctcgcatcgcccgccaccggcgagctcctcgcggagtatcccagacagtacggacggtcgcgcaatgtggaggatcccgcgctcgtgcttccccggctcgcggtcaaaccccgcgcgtggcgggaaagctcgatccgcccggacgtgcccgacgatatacgcgcgtggcttgattccatggacgaaaagacgttgagggagagcctcaaagcgatcggggacgcgtgccgggcggccgggttcgatcccgcgatgcaggcgtgcggcgagatcctgcgctcgaacagggacatgggcctgcacgcggactcgctcaccccgatcgcgttgcgcatgcgcgacggcgagtgggaataccccggcgggatcgaggagcccgacctgagcggctacgaccggttcatcaccggcacggacgacggaggggaagaacggtgagcgtcagacccgatccggtgatcccggagacccgacgcaggcgcgcgtccacgaccgagaaaagcgaacgcatcctgaagatgagccgcagcctgaccctgacacgcagcgtgctcgccggcacgctcgccgaggccacgcccaaccagctcgacttcatcgaacgatggttcacggccgaactcgactcgcgcgagcgatccaaacgcctgcgcctgctcaaacaggccggcttccccgccgacaagaccctcgacggctatgactggaccaacctgaagatgcccgccgactgggggcgcgcgcagctcgagaacctcgacttcgtcgccggatgcgaggacctcgtgctctacgggcccgtcggcaccggcaagagccacctggccatcgcgatcggacggctcgcctgcgagcggggcgtcccggtgcgcttcttcaccgcgaccggactgctcatgcgtctgcgccgcgcccagcaggagaaccggctcgaccgggaactcgcgagcatcggcaaggcccgacttctcatcatcgacgagttcggctacctgcccatagacgaggagggcagcaggctcctcttccagatcatttccgattcctacgagacaaggagcatcatctacaccaccaacatcgaattcagcggatggggacgcgtgctcggcgacaagaacatggccgccgccctcatcgaccgcaccgtccaccacggacggctcatcagattcgagggccgctcctaccgaagcgaacacgccctcatgaccaaataaccaacacaacgcagacaggcagcggccgataccgcacaccctgcggaaaacccgctgcctacactgcggaaaaacaccgctcacaaagcggacgccaacttgctaaaacacaggcatgtcggcgaccggttcgacctccagcagccgaaatcctgatgacgctaacgacgacggccgccgccacggtcgtaaccgcggcgcttcctgccgcagcgggagcatcggagcatgcccccgcgtggacgcacgcggatctcgagcacgggtccggaacgcagcggcgaatccgtgatccgcacatcctcgaccaccgtgcctttgacgttgagaagctgtttgaatatgccgttcatcaggcgcctgccgccgggtagtacgtttttcttggtcgatgaacatcccacccaaaaaaacgccccccaacgactcaacgacgaaccgccacccacgaaaacagcaatagggcccaaaaaatcggacgttatcttattgctacggtacataacgcacgcatattcgcgaggaatgctcactggaatatatgagggaatgctcacaacacttgagaagggacgttgttatgcaaatcatgtatgtatgcaccggcaatcaatgccgttccgtgatggccgaatactacacccgagccaagcttgtcgaccgaggaattggcttgcagagcggcaatatcaccgtgcgcagcgcgggtactctgcactatcccctcatcccgctgatccgatggttatcgatttgctgaagaacgacggcattgacgcgaattcccattcttccacccctctcaccaccgatatcagccggcaagccgacctgattctgtgttttgagcgtgagcaaatttccgatttgcttgagcagaatccactggctattcgcaaagtatttctgttcaatgacttcgtgaacgcttgcaaacatatgcatgctgagggtccgattgccggcgataccgccgcagacaagctcatcgaaatcatggattgcgtacctatgctgcggccgttttttgcctacggcactcgaaaccgaagaccctcatcgtcaatcacgcgaggtgtttgaacgcgtgtatgcggaaatcaagcacggcgtcgatattatgctcggtgctgtggcctgaatgcaatatcggcgaatagagccagcaaaaaaggccgtcagttattgcgatgttgaaattgcatatttctatattcaatacggctgatattgcgggctcttgttttcctcttttcttggtattggttaaatcggtactattcggggagcggaatacgtaggtcaaatgttcttcaatcatgcatgcatatgatttgtataatgcgaaattagctggttacaattagtgacgtaaataaaaacacgtaaccaatgcaataaggagagcaattatggcttcattgcttcagggattcgaagaggttcagctggtcaagccggtgggcaagaccgttctgaccgttaccgattccgccattcgtttcaacaaagccaccgctgaagtgctcggattcccggcgtacgtcaaggtgctgattaacgacaagaccaagcagatcgccgtgaccccgaccaccgccaaggccgacaacgccattaagttcagcaagcccgaaggcaagcaggccgcttcggtaagcgtcaaggaagccacgctcattgaagcagtgaaggcatacttcactctgcccgagactccggaaggtgaaatcgcctaccagtccgtcaacggtaccgcctaccccgaaagcaagaccgtgattttcgatgtggccaatgccaccgctggcaccatgaagcgccgcggtcgcaaaaaggccgcctgattcgacacatcgaactggatgcattcttgccggtagggccaaggggacgtcaaccgtgaaggttggcgtccttttgtttgcacagtccatgctcggtatttcatcgtcagacaaggcgtgatataacctgagaacaacggattttcagggaggacagtggttcggatgcctgcatacgcacatgaccagtacgaacgcggacggcatgttatggccgagaccgagacggacaagtcatctgctgcatccagcgtcgaaaagggcagcagcggaaagccacactccatcatcacgtatggcattaacatcgcgatcacgacggcgaatcccgacgagaacattttggatcgccgacccaagcgggccgccgtggatttcgccgaaatcatcgccgcaaaccaattggcagcagtacagtagacgatacatgtgcagcagcttctgcacacgcacaccaccatggtgcgcgtctcaagtagccctgcgattatcaatctctccggtttcatcaccctcagcacgtggaaggccattagcatcaagacgaccttcaccggcgcaaaatgcttcgtcaacaacgcggccctcttcatccacagcatggagcagcaaaagagaacggcagccaacgccaaggccagcactaatctgcaagcgattgccgacctgcgcgacctgaccaaccgtggccgcgtcaccgtcgacatcgacgccgaacccacacgctccagcctcccccagcgcaaagcccacaagcatatacagctgcattaaactatgagtcatagtgaagacgaggggccggaacccgtcaagggttccggctattccgctgacgaatcagcggcctcgcctgaggctcagaccaagcaacaccagtgtggcgatgatgatagccgtcgaccatccctgtccaacttggttggccagagcgatcaacaggcccgtcatcaggccttcccggtattgccggtcagatctcggacggttgtcatggtcattgccttccatgagaacctcctctttagttgtaaccagtcactatgcctgctggcacaatgacaccgtgccaagacgccacgctagtagttccttggtttggtctgtccagtgtacgggggaaggttcgatggatgctggtatgctgtgttctagcagaaaggtcgcgctagcttcggggcaatcttctaggcggcgccactgactttcgcctcgttggacctgactgccgaggtttcctcaacctcagttgtaatcagaaaggtctctggctggtgaattcagtcggagaccttttactttttcaattccaaccgccttcatcaagggactcacccaagctgatttatccgagcgcaccgggctaagccgcccttggatcaaccaattcgaacagggcaaaatcgagaacgccagcatcggccgtatcctgacattgtgcaacgcccttggaatcactctcacagtttcctacggcacccccgaggagacaaacgaaacagcccccagtaacgcacaactttcactatcgatgccgggccatacgctcatgtcaagagctatgcgattctggaaccggtcaacggaacgccccggctggcaccactctatgacaatccctgttcgcctacgacacgcaacacaaagcacacgcatcctgcaatggttcactgatgccgagtaatggtcatagatgacctgcgcatataacacaagcgttccgcacgtcctcagggggcccatgatagaggggtgttcctatgtttttgtcaatctttgtgtggggtgtcgtgttggtgtgtggggtgttcctatgttttttgtcaactccttggggagttgacgtgtcgggattccggctggctgtcgtgggcgcgcttcgccctgccggtggcgtccggcgtcctttcccgtgtggcccggttcaggctacgagggctggttcctggtagaggacgccgtttttgagcatgctgtagatcacgtcgcagcgtcggcgggcgaggcggatgacggcggcgttgtggtgcttgccctgctcgcgtttgcgttggtagtaggcgatggacggcgggtgtttggtggatgcgacgaacgcggtctgccacagcgcgttcttgaggcgtttgttgccccgtccggagggtctctcgcccttgatgccggtgccggactggccggtgaccggtgcgatgccggcgtaggcggccaggtgggccgcgcttttgaagttggcgatgtcgccgccgatgccgaggaggatgttgcttgcggtcctgacgcctatcccgggcatcgacgtcaggaccgtgagaagagggtggtcctccagcagggcctcgacctgcgtgccgatctcgcgacgccggtccttgatggccttgatgtcgcgggcgatggaggggatgatggtttcggccatgccggtgccgggcacggtgacggtctgctcgccgatggccttgaacatgtcgtcgatgatgcggccggcgcgaagcccgttggacctggcccagtccttcacgtcctcgatcccggcccgtttcatgcccgcggggccgccgtaccgttcgaggagcgcgagcgtcgcgtcgcgggtggcgcgttcccctttcaggacgcgttcgaacgcgggatgagcagcattcgtgctagggtgtgcagaagaatgaaagaacaagggcattgttcctctgaaggttgaggggaatcacggaggaagaatttagacatcatgtcgaaagatagaggtacagcatttgtatcatccacgcaaaataatggtactggcaccaggtcaatgcctcatgtgaggatcagcgccagccgagcgtcggcatcgttctctgcaccggtggatacggcagccatcacgccgacattctttgacggtacttatttctcttctgctccggacggtagctctactcacaacgacaatatgggcactcactatctcaccggctattccattccgaaatggcgctacatttacaacaccacactggtggcactcgacctgttgacgatcattgcggcctcaggaatcgtgttcttgttccgtccttccgcctacgcatacgtgcgaggcataggtcctggagaatacggcatattcagcttcctggcgctggcttgcgcctcttggctcatcagtctatatgctgcacgcacttacgaacggcataccatgggtgaaggttacgccctgtatgccaagctactcaacgcagcgttcattgactttatcatgctatgcacgttgggctacctccccgttgtctaaatgaaagtgcaacacccgttagattggaaattgcctagaaaacggagtgcgagaaggtcgctcagatcgacgtccagcagccgccctattccatggtcgaccgctcctccgaggacctcatcaagtggggttacgagcgtggcatcgactccttcacctatggctcccttggcgcgggcatcctgtcgggcaagttccgcgagctgacgaagttcgaggaaggcgacgtccgcggtggcttctacgactacttccgggagcccaagttctcgcgcgtccaggagctgctcaaggtcatggacgagatcgccgaggcccacgacaaacccgtggcgcaggttgccgtgaactggagcacccagaaggagtacgtgggcaccgctctcgtgggcgtgcgcacggacgcccacgcgattcagaactgcgagacgttcgagtgggagctttccgccgacgagatggccaagctcgacgccaggctcgacgagctgaagatcggctagccatgagcgccgaggataggaagtaccccacttccgagcttgaggtgcttgagagtggcgcgagggaggttgtcgagcctaacggcctgaggctgatgctgaagcccgtgccgggtgacgaccgcgagcacgtgctcgatccgcgcgtctatgctcgtgcgcacgcgaagctcgctgcggctcctgcggcggggtcggcgccggccggaccggtggacgtgatcgcgtggcgctccgcgcccagcaaggagacccacgtcgtgaggggcgcgaacgttgccaagaagaccgtcgtcatgaacttcggcgacaagggcattccgctgcacatcttcacgccggaggggcacgaggatgggtctgccgcgctcgtgttcatccatggcggcgggttcatggtgggcaacatcggtcagtacgagaactgcctgcgcgacatcgtggagcgcacgggttgcgtcgcgatctatccggagtaccgcctgtctcccgagacgatgttcccgggtggcgtcgaggactgcgtgaagacgctcgactggcttgtcgatcacgctgacgagctgggcgttgatgcgactcgcattgccgtggctggtgactctgcgggtggcagcctgtcgaatgccgtcgtgctcgagggctctcacgcggatagaatcaaggcggttgtcgagctttatccgctcgttgatggcggtcccgttccggatgagtggtcctatgacctgtacgaggtcgtggatgagcagaggcccgaggcgctgagcagggttgatcgcattcgcctcgccaacaacgaccttccgcccatgtacgtcaacggcgatgcggacaagatgctcgacccgctgatttccgcgctgttcgcggaggacgtgagcgcgttcccccgcacggtcatcatctcttccgagtatgactatctgcgctatcaggacgagctgttcgcgaagaggctgcaggatgcgggcgttgacgtcactgcgattcgttatcgcggctgcgaccacggcttctnnnnnnnnnnnnnnnnnnnnnnnnnnnnnnnnnnnnntcgcgtcatctccgaggagcttgcgaagatctaggggctcgtcgcggcgacctcctggacgagtgacggtccggcgggatgctaggtgcgtcccgccggacctttgcgttggcgggcgcgtgccgcttgccggcgggcgcgtgtggggtttgcctcggcggtgccggattgactgggggacgcgtttaccgccgatcttccaagcgagcccagcaagcaaaccgcgagctgagccccaagggcattgacaagggcgtgggcgtggcgcgagcactggagtatctgggatgcagccgtaacgcgcgcacnnnnnnnnnntttggcgactcgggcaacgacctgggcatgctcgtcgccgtcgagacggctgttgccatgggtaacgccatgcccgaggtcaaggcagtcgccgactacgtgaccgacgacgtcgcacacgacggcaccgtcacagcgatgcagcatttcggcctcatctaatgaatcccgcgttctgacgtttgcccaaactgcgactctttgcttttgcatgctcaatcgatttatcaatccaaacactgaggtgtttataccgttcgccgagaagataaaaaaccgcagttcacgccttgataaacgtaggtaaagtgtttagcagtttatcggccgtatgctaacgaaaggaatcaggcagatggcaatcaaggtgttcgctgacggtgcaaacctcgagggcatgctcgacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccatctttacgcctacgcaggttgacgagatggtcgaggccgttgacgccgagacgccgtccatcatctcgctctttgccggccgtatcgccgataccggcgtcgaccccattccgtttatgacggagtcggtcaagaaggccgccgccaagcccaactgcgaggtcctgtgggcgtccacgcgcgagctcatcaacatttaccaggccgaggcctgcggttgccagatcatcacggtgcccaacagcatcctggccaagcgcaagaacatcggccgcgacccgtacgaggtttcgctcgacaccgtgcgcggctttgccaaggacatcgcctcgctcggcttccatatcctgccgtaacgcgaacactgactgtgccgtgggctgtccgccccggcctttcctttccctatcgctcacgcgcttcgcgagggtcgcgctaggcaaaggaaaggccggggctgccgacacgaactgaatatcgccctggctctcaatcgtgagggtcggggcgttttgctatagcgggactgtcagacttgcaagtttttgtcatcgcgtgagaagaacttgcaaagtttgcaagtttttcccatcaggtgagaaaaacttgcaagttcggcgatggatggcggcggctcgcccttctgttacttcccctgcaccatggtgagggagatctttttgcggtcgcggtcgaccttttcgacccataccttcaccgtgtcgccgacgcgcaccacgtcgctcgggtgcttgacgaagcggttggccagcttggagatgtgcacgaggccgtcctggtgcacgcccacgtcgacgaaggcgccaaagtcgacgacgttgcgcacggtgcccttgagttccatgccgggctccaggtcgtcgatggaaagcgccgagcggctaaagaccacctcgggcgcgtcgtcgcgtgggtcgcggccgggcttcttgagctcgttgacgatgtcgatgagcgtcagggtgccacagtccaggtcgcttgccagcgccgagatgctgcccaggcggcgctcgatatcgggcacgccgccgcggctgagctcgctggccgccacgccggcgcgctccaggaccgacgtcgccacctcgtagctttcggggtggacgcttgtggcgtcgagtggattcttgccgccgctgatgcgaagaaagcccgcggcgttgaggtatgccttggggcccagcttggggaccttcttaagctggcggcgatcggtaaaggcgccgttttcctcgcggtaagccacgatgttcttggccacgctcggcgtgatgcccgacacgtatcccagcaggctcgcgcttgcggtgttcacgtcgacgccaacgcggttgacgacgtcctccaccacgtggcccagcgtgcgcgaaagctcggcctggtcaagatcgtgctggtactggcccacgccgatggactggggcggaatcttgacgagctcggccagcgggtcttgcaggcggcggcccaggctcatggcgccgcgcacggtgacgtccaggtcgggatactcctggcttgcgagctcggaggcggagtacaccgacgcgccggcctcgttcacgatcgtatagcgcaagccgggcgcctgctcggcaatgaactccgagacgacttcctcggtctcacggctggcggtgccgttgccgatgacgatggtgttgacgccatnnnnnnnnnncgccatcctttttgacgaggcgggcgagctcgcgcttggtgccggcgacgtcgtggcgcggcttggtagggtagaccacgccgtggtcgagcagcttgccggtctcgtccatgacggcgaccttgcagccggtgcggtagcccgggtcaagcgcgagcacgcgggcgccgcggacggggcgggccgagagcagaccctcgagattcttggcaaagacgttgatggcttcggtctgggcgcggacggtgagcttggcgcgggcctcgcgctccagcgagggagccatcaggcgtttgtagccgtcggcgatggcagcgtcgaagacgggcgcgaagacgccctgacggcggggccagcggctgccgaggcgcgccgtggcggcagcgccgtcaacgttcacgcgcacgcggagcttgccctcgcgctcgccgcggtcgatggccagcacgcggtggttggggatgcggcgcagcggctcgtcaaagttgtagtagggctcgtagggggtcttctcggcggggtcggtggcctcgacgacgatgtcggcggtgttttgcgtaaaggcgcgcaggtcggcgacgttctcgggatcttcggccaccgtctcggccacgatgtcggcggcgccggcgagtgccttctcgggcgtgtcgaagccggcgtcctcgttgacgtaggccgcggcggcgtcgagcgcgctgtccttggcggatgcctgcatgatgatcatattggcgagcggctccaggccggcctcgcgggccttctgggcgcgggtcatgcgctttttgcggtagggcttgtagaggtcctcgacacgctggagctgcgtggcctcgcgaatttgctgttcgagctcgggcgtaagtttgccctgggcgtcgatgagcagaatgacgtcctctttgcgctgttcaagattgcgcaggtaggacaggcgctcgtcgagtgcgcgcagggcgacgtcgtccattccgcctgtggcttccttgcggtagcgcgagataaaggggatggtgttgccctcgtcgatgagcttgacggctgcctcgatgttggcggccttaaggttgagctcgtgggcgagctgggcgataagatccatgggactccttgcgtttaaggtgcgtttgcagcacagggctaccaaggataccacccgtttcaaaagactgttttgggcccgcgccacgaaaacgacctatctactacgtttgaaccgtatgggtcgaccatagcggcattttcggaaaatcagcaagccgtctaccagcggttttgatatttcggatttcggtatggtcgagggtaatcggttaaacgtagtagataggcccatttcgtggcgaacgaatcaagccgaggtgcaaaatagcccccgccccagaaaaatcgtcagcgaagtagcaaaatgccccgcgggcaggaggctgctcgcggggcaaagaagaggggcttatttgtggcggaccgagggactcggcatggggtttctgccgcggccgctctcaaggcattacagctcgacgagctggccggtctcggcggcctccttgatggcgttgagaagcgtgagcgtcttgacgttatcggcgggggttacgacgggctcaacttcgcggcggacgaccttcacaaagtgcttgagctgcatcttgtgcggcagcgccgggtcgacggccggaatctccatctgcagcggcttgtgccagttggaggcgccgtcgtaggagaactgatgcaggcggggcagcgaaagggcacccaaggttccgccgataaagtaggcgtcggcgtcgaaggggcggtactgcggatcctcgcgagcggtggcctcccagttccaggggctggcggtggcgtcggagatggtcatgctcgcaagcgcgccatcggcaaaacggacgttgaccacggcggagtcctcggtctcaaaaccgcgggcggcgctggactgcatgccctggacggcgacgggctcgcccagcaggtagcggagcaggtccacgtcgtgaaccaggttgaccaagatcggtccggcacccttcttgcggcgccactcgacatcgaagtactcgtcattcttatagatcatgtagtggaagctcgacacggtgagcttgcccagctcgccggactcgatgatctccttggccttgttgacgaaggggttgtggcgacggtgctgacccacgagcacgggcacgccggcggtctcggcctcggcggcgaaggcctgggcatcctcgaggtcgttggagatcggcttttcgaccagcggcacgatgttgcgcttgatggcctcgcgggcaacgcccaagtgcaggtcgttgggggtggcgatgatgacggcctcgggcttgacctcgtccatcatctgggcgggatcggtaaagaacggcacgccggcagcctcggccgtggcgcgggcgccctcaaaggcgtcggcgatggcgacgagctcggcctcgggctcctcggtgacaaagcggatgtggttgcggcccatggcgccggcgccgatgacggcaatgcggacggggttgagctcagacatttcgactccttaatgctggtggctggtggaatgcggcaagaggacggcccttgccgcgtcaagcaaaactaagcggacttcttcttgctgtcggagaccatcatgtagacggtgagcacgacggcgatggcggcgatcacgatggnnnnnnnnnnnnnnnnnnnnnnnnnnnnnnnnnnnnnnngcggcgctgccggcctcggcgtgatacagcacggcggtgatgggctggctgatccaggtggaagcggcgtagcccaggaacatgatgccgtagttgacgccgatgttgctggtgccgaaggcgccaccggtgagcggcgggtagatgacgagcagggcgccaaagctaaagccgagcagggcgagcgccacgaagaacatgctctgcgtaaagctcatcgacatgatgacgagcgcgacgatggtgacgacaaggctgatgagcagcgacttgtaggcaccgagcttgtcgatgatctgaccaaaggacaggcggccgaccaggttggcgcaggtgttgacggagacgaccacgccgccgagagcgacggcagcggcgctcgtggggtcggcgaagagctggacggcggcgatggaggcaaccttgccgacgagcagggtgccggcggtggcggcaaaggcgaaggtgatgatgaggacccagaagcgcggggtcttgaccatctcgcccggggtgaggtcgccgaaggtaccggcgtgcgcgccgcccttgggggcctcgaagccctcgggcagccaaccggcctcgggggccttcaggaacagggcggaggcggcgatcatcacaaagaagatgacgccgagcgccttaagggcgccaaagatgccaaggctcgggatgagcagcgaggcgagcaccggggacagcacggcggggccggcggtcgaagcagcgagggtgatgccggaggcgagacccttcttgtcgatgaaccacttctgactcgtggtgagcgccgggttgtagcccaggccgttgccgacggcggcgacgagcgagaaccacaggtagaactgccacggctcggtgacggtgccggacatgaaccagcccacgccgtagcacacggcggcggcgatcacgacgttgcgggggccgatcttatcggagatgcggccggcgaagatgcccgtcacggccatgatggtctggaagacggggaaggcccaggtaagggcgctggaccactcggggtaaacggcgagcaggtttttgctcacgacggaatacagcgcgatggagctgatgaagaacatggtgacgcacgcggcggaaagcacgacggcgcgacccttgttggagttggtggaagccattggactctttctaatcgatacggggaggggaggggtttgcccgcgtccctctctaccgggcaggtttactggtcggtcggcttggcgacgccggactcatcggaccagagctcgacacccttgttcttaaggtagttgtcggcgtatgcgcgacggccgccgggcttggcggtgaggtcgcccatcatgttggagaagccgccgtcgaccttgatggcgtcgccggtggtaaagtccgagcgcttggacgccaggaacatgacggcgttggcgatatcgctgacctcgccgatgcggcgcgtggcgatcaggcggctgcggctcttctcgacctcggggtcggcatagaagttggccgacatgggggtcttgacgaagcagggctcgacgcagttggagcgcacgccgtacgggccccactcggcggcgagcatcttggacatcatgttgacgccggccttggtggagctgtacacgcccgagaacgtctcgggggagtggctggcgacggtggagatgtgcaccaggcgaccctggccggccttgatcatctcgcgaccaaagcgctgcgaggtgatgaagcagccggtgaggttgacgctgagcacctgctcccagtcgctcagcggcaggtcctccatggcggcgaagcgcaggatgccggcggtgttgacgaggacgtcgacgcggccgaagttggcgatggtggcatcgacggcggcctgaacctcggcctcgtcggtggcgttcatcttgtaaccctcggcgtggatgccaaactcggcagcgagatcggcggcagcggccttgaccttctcctcgtccaggtcgagcannnnnnnnnngcgccattgcgggcgaactcgcggcagatctcggcgcccataccgccgagtgcgccagtcacggcgcagacatcgccctcgagcttaagccaattgctcataggaacttcccttcttgtgcctcccagtgggtcgctcccattaaccgacccacgtggttttcgctggttatcgtatgctttgcgtttgcgcaggtgaattgcatatttgttagaatggcgttaactgtaggtttacaccgcatgatgcgatttgtacctgattgagcatgtgacctgcgaaaacgaccccctgcggcaccgtgtggccgtacgtgcgaaaacggagagaagacgtgtacgatcgacgacttgaggctatttcggccgccgcggagctgggaagcttctcgcgcgccgcggcaaaattgcgcgtgtcgaccccggcactcnnnnnnnnnnnnnnnnnnnnnnnnnnnnnnnnnnnntatcgggattcgaggccgagtttggcattacgctgttcgagcgctcgcattcgggcgtcaaggtgacgccggcgggcgcgctgttggtggacgatgcgcgctcgatcatgcgccagtccgaggatgccctgcgccgtgcccgacgcgcgccgggcgatggcggtgcggtgcgcctgggcgtgtcgatgatgtgcccggggcgccaaacgctcgcgctgtggccgcaggtgcacgacatggagccgcgcttgcgttttgagattgtgccggtgggggacctttacgatgagcgcgagaccgtcatgcgcagtctggggcgcgaggtggatgtggtgcagtcgagtttttcgaccccgcgctggggcgacgcctgccaaaagctccgcatcgttaccgtgccgttttatatcgacgtgccgcgcacgagcccgcttgcgcgcaagacgcgcatcacagttgccgacctggagggcatgcgcctgcgcgtgctccgtcacggcaacgacgccatggacagcctgcgcatcgaccttttggccgacggcggcgtggacgtgatcgacgtggatagctttgactttgcgctttttaacgcgccacggtcttcgtttcggtggcttctggtcacctgaccctccttgcggtaggtcaggtgttgcaacgatcactagaacccgccgagtggtaggttattcggctttgagggtgggctttttggtgcgcgagcggatggcggcgttgatgggcacctggtgcgggcagggcatcgagaacacgtgcgccggattattgatggcgggtactggcgcgccatcggcatcgcgcaggccggtttccggcacggtaaagaccaatggtctctcgccaggcagcaggaattcgacctgttgaccgggctcaatcttgttacggctcatcagcgtgacacgtccgtcttcgtccgcgctccagctcagcacttcgcccactaccagccatgagcggaagtaggcggagcggtcggtgttctgtgtgaccttgtgctccgggtaatagaagccggtggagtagtcgcggtgggccaccttgtcggtttcctcgagcagccattcgggcagttcgacgtgtggggccgggcgaacggccgcatgtttccaatcggtctcaatctgttcgaccgcggtgttggacttgcggcgcgtggaacgggcgtgagagctcatgccgtcgggttcgacggcggtgccggccggcgtaccagaggcagttgagtcgacggcatcagcaaccgtcacgcggtcacgttctgcggcaaccgagccggtgaccgaatcggcaaccgcagtatcagagccacggtcatatccctcatcggccacaccggcgaacgcggcatcagcattgcgcatcacttgatcttcggttccttggccaaaatcggggtcgcccgggcgaatcacacggtcatggaaaggcttcaaaacattgccatcagcgtcttcaaaaccgcgttgaatcatgtattcattaaccgcggttttgtaggcgttggtcatggcggcgatatagtaggcgcttttcgcgcggccttcgattttgaggctggtggcaccggagtcaatcaaatcatccaagtgtcccagcatattcatgtcctgcgaattgaacagataggcgccgttctcggtctgctcgatcgggaagtactggccggggcgcttctcttccacgatcgaatacttccagcggcatggctgggcgcattcgccgtgattgccatcgcggccggtcagatagttggagaacaggcagcggccggagaaggccatgcacatagcaccgtggacgaagcattcgatgtcgaggtcatcgggaatgttggcgcgaatatcacgcacggcctgcaagtccatctcgcgggccaacaccacacggcgagcaccaagctcgtagaaggcgttcgcagcctgataattagtcacgccggcctgggtggagacgtgcagttccagattcggagccacctgacgggccatcatcatcacgccaatatcggagacgatcagcgcgtccacgccggtgtctttgagctggccgacgtactcgcgcatggcttcgatctcgttgttgcgcggcagcacgttgcaggtcacgtacacgcgagcgccgcgttcatgggcgtagcgcgatccttcctcgaaatcctcaaggctaaggtttttgggggccgatcgcatgccgaaggctttgccgccgcagtagacggcgtcggcaccataatcgaccgcggttttcaggcccctcaggttgccggccggggacaacacttcgggctttttgcgggtggggaggttcatcgtcgtattcatcaccgcaatagtgtagtggtggccgtgtaatgcgggaggggctaccgttaggctggatgacatgaagatcgatatcgtgagcgtgttccccgaatactttgaggtgatgaacctcagcctgatgggcaaagcccaggccaagggattgttggagatcaaggcgcacaacctgcgcgactggacccacgatgtgcatcattcggtggatgatacgccagtcggcggcggggccggcatggtgatgaagcccgaagtgtggagcgaatgtctggacgaactgctgggattctcgcagccgtccggctcccccgccccatccggcgcaccggtgctcatcttcccgaacccatcggccccgttgttcacccagcgcgacgccaccgagctcagccatgccgaccatctgctgttcggctgcggccggtatgagggctacgatgcgcgcatcccggactactaccgcgcccaaggcgtcgacgtacgcgaatattcgatcggcgactatgtgctgaacggcggcgaagtagcggtatcggtgatgcttgaggccatcacccgcctgatgcccggattcatgggcaacccagattcgattgttgaggaatcctacaccggcgagggcgcactgcttgaacatcgccagtacaccaagccggccgtgtggcgcggtattgcggtgccggatgtgctgttgtccggcgaccacggcaaggtggaccgttttcgccgcgacgaagcgctggcccgcaccgccgagattcggccagaccttatcgcggcactggattgcaaggcgctggataaggccgatcgcaagaccctgatggccttgggctgggaggtctccgccgcccatccgcgccggctcgccgattaattcaccacacggtgggagattcactacgcggcggaatcgtcggaacgctctatatccgagtcgtcatccgcggattcgatgtagaagacggcggtttcgccgtagttgcggctttcggtgatttgccagcctccgggggcagtgggatcatccgagcgtaccgagcgttcgagcatgatcaccgtgttctcgttggtggcgctgcccgccgccagatcggacagtagctgattgcattcagcggtctcataggcatagggcgggtcgatgaatatcacgtcgaatggttcgccgaagccgccagccacttgctcggcttttttgaccagcacacgggccttgagcgaagcatcccacgaacgattcttctgtagctgtgccaaggtcttggtaatcagcgccgccgcaggccgggaactttccacggccacgagttctcgcgcgccacggctcagcgcttcgatgcccaacgcaccagtaccggcgaacaggtccagtacacgggcatcatccagcactccccatgagtcgaggtgcgagaaaatcgcctctttggtgcgatccgtggtaggccgggtacccgttttcggcgtagcaagcgccacacccttgaatcgtccagaaattacacgcatagctttcactgtacaggttcatctgcgcataccaatcatgaacaacaatggggtgctcgaagcgcaccaatgatatatgcacttcgagtacctcatgtacgaatggtcttgcctccactgaagcacattcgagggcttcccgaccgtgatttcctcacgatcggcatacggaaaaactatatcgtgcgattacgggggcgcagccctagcctcagctggaggtgcctcagctggaggtcaggaaggtttcgttgcctcgggtgaagtcgaggacggcaccggcgagttggacctcacctgccagttcggggtcggcggccagaagctgcccggcacgggtgcgggcgtcggcgatcatgtcggcgtccttgaccacgcgcaggagcttcaggctggacttgccgccggattgggcgtcgccgagcacatcgccggcaccacggaattccaagtcggcttgggcgatttcggcaccgtcgagcgagtggtgaatcacttcgagccgttgctcggccggggagccgggttccgcacgggaaataaggaacgcccacgagttggtgccgccacgccccacgcggccgcgcagctgatgcagctgagagaggccgtatcggtcggcatcaaagatgacgatgcagctggcctgcttgacgtccacgccgacttcgatcaccgtggtggacaccaggatcggagtctcgccgccggcaaaatcggccatgacctgggttttgacgtcatccttgtcgcggccggtcagagtcgcaaaccgaatgccttggaactgtggaagtttctgcaaccggtcggcgatttcggccaccgcatgcaatggcgggcgagccacggtttcgccattttcgtcgaaggtttcgtaggggtcgtcgatgccgatggcatcggccgccgcgcgcgtcgcacggccgcccgcagctgtgcgggcactggaaccagatgctgcggcgcgtccgcgggcagaaccggctgctgccgaaacgccggaaccgccttcgttctcctcatcatccgcatcaatgcgcgggcacacgatataggcccgctcccccgcgtcgactcgcgcgcgaatgtgcgcgaacatacgccccatggtggcggcgtcggcctcattgaccaccacggtacgaatcggtttgcggccgccaggcaattcggtgagccaggaaatatcgagatcgccaaaccaagtcatggcggcggtgcgcgggatgggcgtggcggtcatcaccagtagatgcggcgtggtgccgtcatcggttttggcgttgagactttcgcgctgttccacaccgaaccggtgttgctcgtcgatcaccaccaaggccaagtgcggggcttggaaggtcttggaaaacgccgcgtgcgtggccacgataatgcccggctcaccactggcggccgcagcgagcgccttacgccgggcggcaagcttcataccaccggtcagcagggtgacgggaatttccgcagtcaccttggaagaagagaccgtcgaagcaccggacgcgcccatcgcgccctcaacgtcggccgcggcatcggtctccttggcacccggctgtgcaagggtcaaccccgacaccatcttgctgatggtctcgtaatgctgttcggcaagcacctgagtgggagccaccagcaccgcctgatagccggcgccgaccgcctgcagcatggccgcgagcgccactacggttttgccggagccgacttcgccctgcaacagacgctgcatgggccagtcacgttcaagatcggacgcgatgtcgtccaccacctgactctgcccggctgtcagtgtgaacggcaacgatgcgatgaagcggtcgcgcaaattgggcaaattgggcagatcaggcagatcggtcgcagaaccgcgctccgatgcttctggttgcgtacttggctccgcaaccgcttcgcccaccgacgctcgagctgtttccagcgcctcgttcagcgggcaaggatgcgccgatgacttgtgcgcgtgctgtcgagacttcagcagcgaggtctgcgaaacgaaagcctcctcatagcgcagggtttcgatggcctccttgaaccgggccgtggaggccggatcatgaatggccaggaacgcctcagcccgatgcatgaggttcttggccttgcgcaccgattcgggcagcacatctgggatggattgggagagcgcctcagcaccggattcggcggtcgtgccggacttctcttccccgttttggacggcgatggtgtcagtcgcgggagccacaatgccggctgccccagcgccagcgagttgcccgtcaggcgtggatgacgtgcgggcccccatcatccacagcaatcccagaatcgtctcatgaatatgttcggacgagatacgcgaactggcgtgatataccgggcggggccggcagacgcgggtaagcgcctcttgcacggtatcggcgtcgtatttcaacgcggccccggaaggggcagtcgcggccggcggatacgcggactgcgcactggcatacggatcggtacttcccgcaaacgcgccattgccggatgccgcgtcccgagcgtaaccctcaagccccgctcctgctccggccgacccgggcgcgacagtgaggatttcggggtgcgtgaattgcagctgccccatgtattcgctgggcataccggagaccaccacagacgtgccggcgcgcagccgcatgctgacccaatccacatacgatttacgatacgaaaagaacgtgagccgggccgtgctgccgggtacgcgacgcgaacgggcaaagtcggcgtcgtcaaccgtcgcctcgagtcggtagccgcggcgagcgttcatcggcaccacgcgcatgtctcgtatcacggcggcaaatgccatctgctggccgggtgcggcctcgcggatggcgcgaagcggcaccggttcggtgacgcggaagggatagtaggtcagggcgtcgccgacagtgatgattcccagcgatttgagcgcggacacgcgacgcttgttggtgaccagcgaagcgagagtggtgtccatagtgatgctcatattggcctattctattcgcacggcctctttaggccgcagaaacaacaaaacccgccaagccgaagctcaaacgggttttgctccacgttagtacgcgattcacgcggccacgcgctgaaccttgccagccttgaggcacttgacgcacacgcgcaggcgagtgttctcgccatcaatcgtggtgcgcacagactgcaggttcgggcggaagctacgcttggtacgacggtgcgaatgggaaacggtgaaaccggtctgcggtcccttgccgcacactgcgcaacgagctgccatgatggactcccttaaccttgatgtgtcaagtctttcacgcattcgaccgccggtttcacccgacatgccgaacacacaacttcacaaatatatagcccaataccgacaaccgcaactcttgcgtgtatcatgggcgaacctcggcggttcacgcgcggttcgagcgtaacttgcgagtgggccatcagcggttcacgagcggctcggcattggttcgccagcggtccgcaagtagttcgtcagcagttcgccagcggcgaattacgctgcaaatcgtagcgtttacccgataaaacacgccggccttccttttccgcatccagcaaactctcatataatctcggtataagagacggcaagggacgaaggggtcctcgtgcaacttacgacgaaggaggctgtcatgttgaatctcaagcgaggtatcggcactcacgagcccagcgtgatttcactggggcaagtctgggtggacattatgctcaatgtggacaaggtgccggcacagggcggattcgccgtggccgatcatccgaagccctccattggcggcagctatcgcgtgctgcaggcggccagccgcatgggcgtgccgaccgagcacgccggcattctgggcaacggcctgtgggcgcatttcatccgccagtcattccaagacaacggcattacgcatatcggccaggatcgtcttgatgaggattccggcttccgcgtggtgctgagctccggcgcgccgaagaagacattcatcgcttcctatggcgccgaggctcatggcgactcggacacgttcgacacgctggagccgcagcccaaagacgtggtgcacatcagcggcaacacactgatggaccacacggccaccggcgtggacggattcctgctcaaggccggtaccgacccggctgcacgcgactacacgctggtgatcaaccccaccaatacgttgcgtttggtcaacgaccatatgcttgaggacctggtgctcgcacgcccggtctggtcctgcaaccgtcaggaggccatgacgctggccgagcgacttggtgcgccaatcgacgacagcaaagtcaccattggcggcggacttgacgacttcatgcaccagttgtgcgacggcttgggcgctacactgcgcgcgccgctggtggtgcgtgtcggcgcccgcggcgcttggattcgtgagccaggtggcgagacgattcatatcgagggatacccgaccaaggccgtacacacccgttcggcgggcggttgccacaccggcgtgatgtgcgcgatgctggcaaagggccatagtctggccgaatcggtaaagatcgccaacgcggcggcatccatcgccatccagcacagcctcaacggcgtgccgcaatgccccgattacgacgaggccatcgcgctgatcggcgaatagtcgactataggtagctccccccagtccgcttcgcggccagctcccctcagcgaggggagctatttttgctctggctccccttagaaagaggcccggcattattcatccgccgttcaaccggaatggctcccctaccctagtccgcgcttctacgatagattgagttgaatactgtcgaggagtgtatatgactgatcccacgaatgtccacgaaccggtgccgcaaagcgccaaactgaccgcccgcgagaagaagtggatcatctacgacgtcggcaactcggcattcgtgctgctgtccaccgccgtcatccccatttacgccaaatcgctgatgccggcggacggcaacatcgtgtccgcctggggctacgcgcaaaccattgcttccttggtcatcgcgctgctcatgccgttgctcggctccatcgccgacgtgcaaggcatgaaaatcaagttcttccttggcttcttcggcactggcgtggtcacctgctgcgcaatggccctgcccctgacctggctaccgttcctagtcgtctacattctggcgaccatcggcctcaacggctcgctaacgttctacgattcgatgctcatcgacgccacctcgaacgagcgcatggacaaggtctcctcgcatggctacggctggggctacatcggctccaccgtgccgttcatcttctgcatcgcgctgatcttcggcggcccgtcgctcttcgactggtccacggtggcttgcacgcgcgcctcgttcatcatcaccgccatctggtgggtggcattcaccatcccgctgcttaccagctaccgccaagtgcactatcgcgccacccgtgaccagctgggctcggccgtgcgcggcacgttcagcgaactggcgggcacgttcggcaaaatcgtgaagaacaagccgttgtggatgttcatgatcgcgttcttcttctacatcgatgccgtgaacacggtgatttcgatgagtacctcctacggtgccgagcttggcatcgactccacccagctggtggtggcactgctcgtcacgcagttcgtggccttcccctgcgcgattctctacggtcgtttggccggccggttcggctgcaaagtgatgatcacggcggcggtcgtggcatacatgtgcatcgtgttcttcgccgcgttcttcctgaagtcggccgtggagttctggattctggcgattctggtcggcatgttccagggcggcatccaggcgctctcccgctcgtactacggcaagatcatccccaaggatcacgccaacgagtactacggcttctacgatatcttcggcaagaccgcctcgatcatcggcaccttcctggtggccaccaccacgtccctgaccggcaacgcctcgctcggcgtgctctccatcgccgtcctgctcgtcgcggcactcgtcttcctgctcctgcaaaaggacccgacgcgggagtgaaatcccggaaataacagaataaagtactgtgatagcccttcccttgacagggaggggttattttttgtgtgtcaatacgctggcttgaaaaacagcttgttcatcttggcctttcgctgtttggtgtgggtgggtctgtcaggtggtgacggtgctgaggtcaacgtgaccatggaaggccgctcaaacctcaggtgttgcaaccaccactagaatccgcccgttcaatcgtttagtgactttttgttaatttctgtgcttaagtagcaactttatgtgtgttttctctacggtctggtgtatattatttttggtttaccggtgtatcgcacgcacgatgtgtgaattgccgcaacatcgctgatatgcgtacatggaatctggaggaatgtatctgatgacggcatcaactgaatcgtctacgcaatcccatcatgatgagaaagaggccattgctcccgcgcgacttgtggcctacgcgctcggcaacttcggccagtcggcgttctacaacgcgctaagcacctacttcgtggtctatgtgaccaactcgctgttctccggagtggacaaggccgtggcgggcaagctcatcggcatcatcacctcgctgatcgtgatcattcgtatcgcggaaatcttcgtggacccgctgctgggcaacctggtggataacaccaccaccaaactcgggcgattccgcccttggcagctcatcggcggtctggtgtccgccgtgctgatcgtcatggtctacactggcctgttcggcttggtcaacgtcaacaccacgctgttcatcgtcctgttcgtggtggtgttcgtggtgctcgatgtgttctactccctgcgcgatatctcctactggggaatgatcccctccatctcttccgactcccatcagcgcggcatctacaccgcagccggcaccttcaccggatcgctcgggtacaacggtctgactatcgccgtgatgcccatcgtcaccttcttcagcttcgatgccggccagcagaaccagaatggttggaccgcgttcatcatcatcgtggccctgctcggcgctctcacggctctgagtgtagtgttcggtgtcaaggaaaaacagagcacgctgcgcaccaaggcccaggagaacggtaacccgattgaagcgttccgcgccctgattcacaacgaccagctcatgtggaccgctttgtcttatgtgttctacgccgtcgccaacgtggccaccggtggcgtgatggtctacctgttcaaatacgtgattggtcgcatggaccttttcccggtcaccggcgtcatccctattgcgtgcggtctgattatgtcggtactgttcccggtcatcactaggtgggtgccccgccgttatctgttcctcatcggcatgtccgtgatggtcgtggcctacctgctgctgattgtcgcctccacgaatataccgctgctgctggtggcactagtgctgttctacctgccgcagacccagattcagatgaccgtgatcgtgtgccttgaggactccattgaatacggccagctgaaaacaggcaaacgcaacgaagccgtgacgctgtccgtgcgtccgatgctcgacaagatcgccggcgcattctccaacggcttcgtcggcttcgtggccgtggccgccggcatgatcggttctgccaccgccgccgacatgacggccaaggacatcaacatcttcaagaccttcgccttcatgattccgctggtgtgcattgtgcttggcctgattgtgttcgcgattttcgtgaagatcgacgaaaaggcccatgcgcgtctggtcgccaagctcactgagaatcttgcgacggctggcgatggtggtggtaacgacgatggtgctggtgttggtgacaatggtgagcataatggtggccacgccagcatcgcgtcggaagactccgcattggcggaatacggtcccgaactcgccaagcgggtgttgctcggcaaatagtgttgctgtgcgaatgagctgtttcatggggtggtgattggctcatggggcggtgaattcctcatggggcggtggctgaaaatggctttattctgcggaaggtaaaattttaccgaccgccctatgggcaagttaccgccccatgggattttcgccgccccatggatgtacgggtaaaggcggccgaattgcctcgtgccgccccccgtggatatgcaagttaaagagcatcggcagcatgactgaatgcacatagagcgtcccccgcatggttgtgccacgttccatggcggggtcgccgtggtgactgtcgccagtacacgccatgccacgcgagcacgttgttgccggtgttccatggcggaaacgtcgtgggcatacaccttggatgatggcgacgacgattccaacacagtacccagtaaagtaaccgtcgataatctcaagaaatacgacatcagcccgcaaggccaggccgatgagattcgcgcggtcgccgaggccgtgaacaatatcggcgacaatgatggcgatggcgataagaccaacggtgcgaatggcaacaaggccactggcgtgctgagcaatgccggcagcgcggtgactgccgtgggtcttgcggtcgtcgttctcggtgcagccggcggggccttgtttgctttgcgtcgtaagcgctcctgatagagactgatgcggcattatgatgcggttgccagttgctggctgtcggctgtcgtctgccagatgcggctgtctcggcgtagcgatgcgattctgtcccggttcgcgcatcaatcgattgatgttaataccgggacagaaatcattgtcccggtttgaaaaaacgggcgtttttcgcgtaccgggacaattctcgttgccccgatacgagcgtcaatcgttttatgtgcgaaccgggacaacatgtcgatctcgggattggcggtattccgccgattctgcttgtcggggtatgtggactttgaaaattggttttgtcccggttctcaaaaatgggccgaaattgcgtaccgggacaacgatttctgtcccggtagaaacgtcaatcgattgacgttttcaccgggacaaattcgtgcccagaggaggggaagaggggctccgcaatggcgctgggcatcattgtggttggaggcaaattcgcgtccgggaacaatgggacgaggccccggtcgcaggagtagagcgtgatgttgtcatgattatgaccggctttcccacatggaaggccggtcataatcatgccgtttacctgcacgctccctgcacaccggccgcacatcacccacataaccgtgtacagtggcgtgtagtcgcagcaataaaggagcatcacaagccatgaccaacggacacatcaaccccgccaacgtgccggacatcgccttggaagacggccattccattccgcaggtcggtctcggcgtgctacgtatcgatgacgagggcgtggtccccgtcgtcgaatccgcgttggaagccggttaccgccacatcgacggtgcggccggctacaacaacgaggccggcgtgggccgcgcgctcgccgcctccggatacaacaagggagccaagcgtgaaaccctgtgggtcaccaccaagctacgcgactcccagcagggctacgattccgcgctcaaagctttcgacaactcgctgaaactcctccagctcgattacgtggacatgtacatgatccattggcccacgccgttcgactggcgcagcaccgacacctggaaggcgttcgtcaagctgcgcgacgaaggcatggcacgcacactcggcgtatgcaacttcatgcccgccgatctgaagcgtctgcacgaggagaccggcgcatggccggccgtcaatcagattgagctgcaccccacgtggcagcagcgcgaagtggtggcgttctgcaaggagcacggcatcgccgtggaggcctactcgccgatggcgcgtggcgccgacctcaacgccggcgacggcaccatcgagaagatcgccgccgcccatgaggtcagcccggcccaggtgattctgcgttggcacatcgaaagcggcacgatcatcatccccaagtccgtgcatgctgaccgccagaaggagaatctcaacctgttcggcttcgccctgaccgccgacgaacacgctgccatcgacgccctcgacggccccacccgcgccggccacgaccccctcaccttcacctatgcgtgattgatggcacgtcgtaacacccacttccgccgtcgtttcaacgcctccgggccgctggagcgcgtgctgattctcatcgttctcgccgtagcaatcggcgtgaccatcggcctgctactgccgcaggtcagctccgacgcggccaaaatcaccggtggctacactgccaccggttcagccgccgacactttgaacgcgctcgccgtagacgacaaccaaagctcctccggctacgaccgcgattccttcggtttccgcaccaccgacgtcgacggcaatggctgcgacgtacgcgacgacgtgctcgcccgtgatctcacggacatcacctacaaatacgccggttcctgtgtggtcgagtccggcacactggccgatccgtacaccgctcagaccatccattttgtacgtggccgcgccaccagcgccaaagtgcagatcgaccatgtggtggcccttgaaaacgcttggcaatccggtgcgcgcgactggtccactgccaaacgccatgaattcggcaatgacccctacaacctgctggccgtcgacggcccggccaatcaggagaagggttcggcttccgccgcctactggctacccaccaacgccgactaccgttgcgactacgtggcccgccagattggcgtcaaagacaagtaccggctcaccgtcacctcccaagaaaaggacgccatgctcgccgtcctccacacctgcccgggccaggccgtgcccgcagacgaataggggctaccgctcaggattgttgagcataggtgcctgcccctcgtcataagcgcgcaggagccgtcggagcaaaaatgtggtgaagtatggtgcggtgaacacgtgttcgctgctaccgatattgccggcggatagtttcacgccgaactgaatttccggataagaatccgaagcgattagcgtccgcatggatttggcggtgccttttttcgatttcacctccaccggcaccagccattcgcgcgtgcggacgaagaaatcctgttccagtgtggaatcctcttttttgtagtagtacaggtcatagccggatttccgtagcgcttcagagacgatgctctcgtacatagcacccttatagacaccaagattacgattggcccgcagatcatcactggcctcgtcgtcaagcatcgctacgaacagaccggtatcgccgaaatatatcttgaacttgttttcgtcataattgcctttcaacggcagttcaggataggacatacatcggcagatattcaccattcccgaggtttcaagccattccacgcatcctcgatagtctttgaaacgcgctccgctggcaaccttgctgatttggaacttcttgttttccttggcgagttgcacgggaatatggttgagcacgttgagaattcgtgcctgatcgagtccttgcgcgtatttgcggatatcctcctggtagtccaaaataagctggcgctgcaattgcagtgttccctcgaacgtgccagtgcgtatatgggaggcgacaaccgcaggcatgccgccaagcacgcagtaatccataaatgccgtggagaagacgttcatttccacttcagagaatggcgtagcatcacacaggtgggtgaacatgctttcgatgacggcctcatcgtatccgcgagcccacagaaattcctcgaagtccaacgatcgcatttcgtagtcggtcttatatcccacgctattgctttcgatttgcttatagctgatgcccaacattgaaccgctgcaaatcacatcatatttgccgtcgattttaaagaacttcagtgcagtggcgatatcaggatgggcctggatttcgtcgaaaaagatgagcgtatcgcccggaatgaactttttggctgggtcgatcagggaaatattgcggacgatggtatccgcgccataaccgtccgcagtgattgcacgatatttcggttcctcaacgaagttgatttccactaccgaacggtagttgtgtgcggcaaagtaatcgatagtctctgtcttgcctacttgacgagggcccttgatgattagcggggagcgattcgggtcggatttccatgcattgagataggcatcggctttgcgtttgagatacatgaggagcccctttccgaattactgctatatcaatgattttacactttcatgagcgagttttctaccgtctggcacatttcatgagcgagttttcggcggtttgtcacatttcatgagcgagatggcgggaaatgccagctgccagtccgccagtcatccatcaatcgtccgcagattgtccgtctgttgacgcgggaaacatgcccgcgctataactgagcccggtatgaagggagaagggaataggaacagacgatatggcagtaacacacaccgcagcagatgccactgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcctacgtcgatcctggcaacgtggcggccaacatcacctccggcgcgcgatatggctacctgttggtgtgggtgctggtgctcgccaacgccatgagcgtgctcatccagtatcagtccgccaaactcggcatcgtgaccaacaaatccctgccggaactgctgggtgaacgtatgagcgatgccggccgcttcatgttcttcatgcaggccgaggtcatcgccatcgccaccgatctggccgaggtgatcggcggtgccatcgccctgaacctgctgttcggattgccgctgttcatcggcggtctggtgatcggcgcaatttccacggtgatgctgtggttccaaggtggcaagacgcaaaccacgttcgagcgcatcatcatcgtgatgctgctgattatcacattcggcttcatcgcaggcctgttcgtggacccgccgagccccggcgaagtggtcaagggcatgattccacgcttccagggcaccgactcggtgctgatggccgcctcgattctgggcgccaccgtgatgccgcacgccatctacctgcactccacgctggtgaacgaccattacgcaggcggcgaaaagccgtcgatcaaaacgcagctgaaaggctcgaaaatcgatgtggcctgggcgctgttgctggccggcaccgtgaatctggcgatgctggtgctcgccgccaactcgctgcacggcatgtctggcacggattccatcgacggcgcacagcgggcgatcacgcaggtgcttggcccggtgatcggcacgatcttctccatcggcctgctggcttcgtcgctgagctccacatcggtcggcacgtatgccggctcggaaatcatgcacggtctgctgcacgttaacgctccgatgtgggcctgccgtgtggtcacgctggtgccggcactgattgtgctgtggttcgccaaggacccgactcaggcgctggtcatcggccaggtggtgctttccatcggcatcccgttcgccgtgattccgctgatgcgatacacgcataacaaggaactcatgggcaagtgggctgatggaaccgtcaagcacgtgatttttatgattgtggtggcactgattgtggcgctcaacgtgctgctgattgtcctgacgctgatgggcagggcgtaatagactccagctgaaatcctgcgatagcacaacataataagaaaccccggttccaacaccggggtttcttctccaacgaggtgctgcacgccgacctggcgaacagccaggcgcgcagccagggcatggcggcgaaggtcgaccacatcgccgaccgcgttgacctgctctacaaggaatcggctcgatagaaaggaatccgaaatgacagaaatgcaagcaatcgcagccatcgtgctgtctttcgccgtgccgttcgcggtgcagctgatcaagaccgaggccatgaccggcaaggccgcgcgcatcctggcgctgggctgctcgctcctggcgggcgtcgtgaccggcttcgtgggcggcgtgcccgcagacccgggcgcatgggtcacgtgcgccttcgccgtggtaggcggcgtgcaggcggcctacacgctgttcaagagcgtcggcatcacgtccaagtggctcgatgccctgctgggcgtgaccgtaggcgggaaggagtaggcaatggctaaactgttcatcatctgcggccacggcgctggcgaccccggctgctgcgcaggcggctgcaccgaggccgagcgcgttcgcgccctgggccagcgaatcaaggaactgggcggttccgaggtcgagctgggcgatacgtcccgcaactggtacgccgacggcgggcttaaccgcctgagcaccgacgcgccagtggtggagctgcacatggacgccagcggcatcgccacggcccacggcgcgcacgtcatcatcaaggagggctttgagcctgacgagtacgacaatgcgctggccgacaagctggcggcgttcatgcccgggcgctccgagaagctggtgcgccgttccgacctcgcgaacccgaaccgagccgccgcgcgcggcatcaactaccgcctgtgcgagaacggcttcatcgacaacgacggcgaccgcgagaagttcaacggcaacctggacgagctggcgcgcatctacctggaatgcttcggcatcactgctggaagcgccccagcagccgtcccgcagccgcagcctgcgcagcaggaaacgaccgagaacttcggcggcacctaccgctgcactgtggactacctgcgcgtgcgcgacgcccccggcctgggcggcaccgaggtggcgcactattccagcggcgagaccgtgacgctggataactggtacaagatcgccgacggctacgtgtggggccgatacacgggctacagcggcgcaacgcgctacatcgccgtaggcaaggccacgggcaagccagaggccgacgactatctggtgaaggtgggataggccatgccgtacccgagccccgcagacgaggagcgcaacggcgggtgcggccccatcctcgcggcggtcgtcctgctgttcatcgtcctggccgccgccagctgcgcgtcgcaggccatgggagcgcaagacgtgaccgtgaggcaagcccgcacggacggccccatatacgacctgcccgagggcatcggccaggaannnnnnnnnnnnnnntgtgcgacgagcacaaccgcgagtacctgctgcttaccaccgagcagggcggcgtgttcctcatgccgtacatggacgaggacggcgagcaggagatcatgccgcaggcctagaacgcaaagaagccgccccgtatggagcggcttctttctatctgacgagcaatacgaacgcccgcctaacgacgaacacgcgtatgtgttcgcctactgaacagttggtggagcttatgagaaaaacggcgaactccaccaataccgccacccgcgcggctatccaactcgatacttgcattgtaagggtatcgaaaaactggtttgttgtcgttggaacgtgccagaaatagccatttctggtgtttgcaaaacaccagatgggcggcttgctgtaagcccgtataacggcataaagcggggcaccccttgtcagggtaccccgcttgaacactaataagaaagcttctggccggggtagatcgtataaggtgccccaatgccgttcttgcttgcgatggtgtgccagtcgatgccgagcgaagcgccaatctcgctgagcgtgtcgccgctcttgacggtgtagacgcgcgcagagccaacgcccgccctctggttgacgattgcctgaacctctttgaagcggtcgcccagaacgtcgctgcgcgtcggcacaacgccgaacattccgcgctccacatcgtctgcgagctgagaagcggaagcgccgtcaatgtagttgatgaggtcttgcacctcttggtaacggtcgccgagcttttcgcggcgctcatcatcaacgccatactcgccgcgcatgaccgccgctgcaaggtcaagcgtcgtgccctccggcgaaggctcggcgacctctgcgggcggaacgtcgggagctgccgcgccggacgggttggcgaacttgccccacgcttcgcgcgtcatataggcgatatcgagatcaagcggcgcgttgaagccatcgagacggccattcgaagtgtattggtggattgcgcagctaccccaagcgccgaagccgccatcgggaagccacggcgaagattggtagccggtgcggttgttgttggcgtactgcgcaacccatagcgcgtgattcggtgcaatcttcgaccaatcttcttcggtgcaaacgctacggctcatgtagacgatgcagcgaacgccggtctgatcgtagacgtaatcgaggaactgctttgccttgtcggttccgatgcgcccgtacatctcataatcgagaacgggaataccgttgccgaagtagttacggcagcttgcgacgaaatgcttagcctgagcgatggggtcttctccgttcatgaagtgatagaagccccagagcttgccgagcttgatagcctgctgaatccacgggtcgcaggtgttgtgaacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaaatcgaccttctctagctcttcgagcgtgaaggcgcgcgccgagttcccggcgctcgccgggtcgcgtatccagtagccgtcatcgtcggcgcgccagatcagcacgacgtgcccgccgtagtccctatcgcctagcgttccgctcatgccagcgaaggcaagccatccgtcagacacgttctgaaggacgggcgcgagatcgtaagaaatcggcgtgctctcaatgccgtattccgggtaatgctcggcaatccacgcgcagaacttgccggggtcgttcacgccatcggtaaggcaggcgtcgcccacgaacgatgcgagcgtgagcggcgtaatgtcctgaagcgtcatgtatttgatagccatagcggcgcacgtaaggccgcagccgtagtcgccgatggtgccgcccgcatagggtatgtagtcccattgcgggtctgtctgaagccatagcggcatgctgttaccctcggcaatcggcctatcgacaacgattgctaggcggtcttcctcagccgccgcgtatccctcttcgcgcgcttcagcgagcgcgcccgcgtcgctctcgatatggccgacgatgagccagccgcagaagagcattgacgcgagcgcgccggaaagcacgagggcgacagcctttagcctactcatcgcgcttcggctcggtgtatgtgagcgcttgcgcggaatcgcccacgccagccgtggtcgggtcagtcacgatgcccagaatcgcgagcacggcgaaaagcgcgttgatgatcgctgccaactgctcgttcagaacgccgaagtcccactgatagccgaacggcgcggcgacaacctgcacgagcagcagaacagcgggaatgagggtcagccaaaacgtcttgttcttaattcgtgcggtgaagttaatcatttcagttctccttttcatagatgaggtctacgcggtcgtagatgtgatcgactttgtttgccatgtcgtgcgagtgctcgcgcgattccctgatttcgtcgtgcagcgcttcagtggaagccctgagagattccatagcggcttgcagcccttccgaaatgttgttgcttcgctccatctgcgcagcgatacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgactgtcgcgccgcgtttcgctcttcaagctccgccttgcgctcgttgttgcgctggtactcgttaagcagctgctttgcgaggattccgaagccgatagcgataaggaacgcgaagaaccattcggcaccgaacgccgctgcatggtctaaaacgctctccgccacgtcagccctccgtcacctctcgccagacggtttcggtgccgacagcccccggctcccatacgttgttggcaacgagggattcccagaccttgccgttgtgcttcacgcgggcaccgagcgggtagggattcgtagaatcgggctgcacccattcgggcacttcctctgtcggcgtgtcgggcgttccggcttcaagcaccttcgcccaaaggctcggcgctgccgtgggcgaccaatcgggctgcgaagtgtgagcctgaaggcacgtgtaaagcacgccctcgaagcgcacgcgctcgccctcggcgtaggcgtggccgtctccgtcccactctgcgaaaagcgcagggcacttcgccgccacgtcgctagagagcgacggcgcttgaccgtcgaaaatggcgatgatcgcgcgaagcttgccctcttcctcttcggtgaatgtcatgtgttcccctttctctcgcaacaaaaaagcccccgctaatgcgagggcttcgataccttgccatgtcggcttcctcagccgaaaagctccttgtatagcgcgtccatgcgctttaccgtctcgtgcgcgctaaggcgcttcatgctgccgcgccacgactggtaggattggttgacctgctcgacggtcataatccccttggcgaccagcgcggcttgcttcttcagcttgcgccgctgccgcgtcacggaggaacggcacgggcgaacgacaacctttccgccctcgccatatgaaaacctcttcttcaggnnnnnnnnnnttcttcaggaacacgaagccgcgcgtcagcttcacaacgcgcgtcttcttgcggttgatgatgattcccagatcgtcgcagagcgcttcgatgcgcgaaagagcgtcccaaagcgtctgcttgtcaagagctatgcaatagctatcgtccatgtatcgcccgctcgccaagatgcccggaagggacagcatcagatggtcaacgggcgaaggcagggcgacggctagaatctggttcggctcgctgccaagacccaagccgcgcgcgccgtgagcgtctatctggtcgctcatgacgcgcttaacgcgctcatcgtcaatggcgcggtcgataaggcgcttgcatgcgtcgtggtcgatgtttgcgaagtagtccgcgaaatcgacctgcaagatgtagccttccgttccgtgctttcggtggtgctcgacaagctggcgcttcatgcgccgaatcgcgtannnnnnnnnncgccccttgacgttcgcggtgcatccctcggcgagggtaggccagatcgcgggtgctagggcgtgacggctcaacgatttctgtatgacgcgctctgagaagtggacagagcagatgtgacgaagcttgccgcgctcgaacaagtcaaactctatgaagccgcgccggaagtctgcgcccatgagaaggtcgcgccgcgctctcatgatgttaggaatgacgcgcgccatgtagcgctgcacgctcgatttccagcgcacgccagcggcagcgccgttggcggcatcgtataggttatcgagatcggcgacggcttctagcgtgcatccctcgatgcgcttagccctgttttccgcgcgcttggcatcgcgccttgctcggcgcgcagccctgcgctcttcagagttcatgagggcaccccgcacggctcgcaatcggcatccagcagccgcttgacggttgaccatgaaacgcggtnnnnnnnnnnnnnnnnnnnnnnnnnnnnnnnnnnnnnnnnnnnnnnnnnnnnnnnnnnnnnnnnnnnnnnnnnnnnnnnnnnnnncaaggcatgcgccagacctgtactatgtacggctgattttatcagcctaggaggaagcacggcagcgggcgcacccagtcgttcgtcggggcattgttgctggcattgccgtagctgctgacatagcacgcgccagacgaagacccgcccatgaccgaccgcagccaccaattgacgcgatgatttccaagggacaacgcgcgaacattctacccctttccaatgagcttcacgcccgcgcgagcgccctttatgagctttatatcgttctcgatgctctctgagatctcttcgaacttagccaccttgacgggtagcttcatcgccagaaggcattgcaggtcttggtaaagctggtttaggtctgccaaggcaagcgtcatgtaatgcttgcgttcctcgacgttccgctgtgtgttcgggtagaaggcatcagccttcacgaggttgaacaccacgcttcgcgccgtctccgccatggggacggcgaagatgaagcgataggatttgggcaccgcgcccgaagtgacaagccgcgtcacttcgtttcgaatcgaaaccgcagtgttgaaatactcgaacgtgcttaggttgcggttccgcacatatacgccgctcaatttgcaacatccccccctccgtgattttcaaaaaaatacttcgcccgcgcttcgcgcggggaagtatgatctggtttaccagcgacacccacttcgggcatgagaacgtgctgaagttcaccgaccgcccgtgggagacgatttggcagatgaacgacgccatcattgacagcatcaacggcatggttgccgtggacgacgagttctacatcctgggggatttctcattcaagatgaccgcccaggacgcctatgggctgcgcaagcggatcgcctgcagacgcatccacctcgtcccgggaaaccacgacaaggactggacccagccggcggtcgcgggcgcgttcaccgtggagccgccgatctgcgtgctcaagatcgacgggcagaagatcgtcctgtgccattaccccattgccgactggcagggcatgagccatggatcgtggcaccttcacggacacatccacagcagcggtggcgcgtacaacgagttcaaccgcaagcagggccttctgcgctacgacgtcggttgcgatgccaacgggcactccccggtgagcctcgacgagctgagggaatggttcgccggagtcgacgagccgtgcggccgggtgaaatggccctggtgggtcaacgagaccggcgacaggcaggtcgagggcgagcttgcggcgtacaagagggaagaggtgattcgatgacggtctatgtgacgggcgacatccacagtgggctcgacatgcaaaagctccgcgactgggagcttggcgacagtcttaccagcgacgactatctcatcgttgccggtgactttggctttccgtggaacttttccgctgaggaatgcgccgacatcgcttggctggagtcgcgcccctacacggtactgttcgtcgacggcaaccacgagcgcttcgatcactgggcggagcgccccgtggagttatggcatggcgggctgacgcagcgcctgtcggacacctcgcccattcggcgcctgacgcgcggcgaggtcttcgagctcgacggctcgacaatcttcaccatgggcggtgccacgagcgtggacagggaatgccgcgttccgtattccagctggtggcctcaggagctcccggatgagcgcgatttcgatgccgcgcgggcaaagctcgacgaggtcggctggaaggtcgactgcgtcatcacccatacctgtgccacgcgcatgctctcgccgacgctctatccggacccgggctgggaacgccctgatgtggaccggctgaccggattcctcgacgagctcgaggaccgcctggaccacaagcgctggtattacggccattttcaccgagacggcaacccggacgaacgtcataccgtactgtacgaccggatcgtgaggctcggggacaaactcctgccgtggggtgcgtactgatggctgtctatgtgacaggagacgtgcacggcagggccgagtacggggccagcaggttcgccttcaggtcttggtcgctgggccggactctgacgagcgacgacgtggtgatcgtggccggcgacttcggctttgtctgggacggctcgaatgctgagaggtattggctcgattggtttgagtcgaagccatggaccacgtgtttcgtagacggcaaccatgagaaccatcacgccttggctaatctgccggtacgggagtggaacggcgggctcgtccatgaggtgcgaccgcacgtgctgcacctgatgcgcggagaggtgttcgacatcgacgggctcacggtccttgccatgggcggtgccgcgagcaacgacaggcagtatcgcagggaggggaggagctggtggcccgaggagatgccgagcgaggaagagatggagcactgccgcgcctcgctcgaccgcgtgggctggaaagtcgaccacgttgtgactcacgaggctcctgccgcccttgctgaggggctgtgccgcgaacgcggacgtgagtaccgcggagatccgctgcaaaccttcctaggcgagctcgacggacggctcgattactgcgcctggttcttcggacattaccacggtgacgaatggctcgacgccgggcatcgcttgatctaccaagacatcgtgccgatcgaagatgctacgcccggttctaggaaccttctggaagcgctctagaagattcctagaaatcagtagcctgacaggagaagcgcggggctactcgtccttcatctgggtcatgacctcgaccttagcctcggccacggccgcccgctgttcggttgcagcgaggcggtccttgagggcggcgacctcggccatcaggtcgcgctgggccaggagtgcgtcgttcaactcggcttgggctttcagcgcggcgtcacgctcgccgcgcaggcgctcgatctcatcgaccatggccacggcctcgacatggagctggacgacctgcctgtcgagctccctggcatcggcgaggtatctgacgctcgcggcatggagctcgttgttctcgagctcgaggctcgcggtatcgagttcaaacttctcctcgataaaggcgacccgctcattgcagtcggcctcaagtctttcgttccggtctctcgcctcgacgagcttgcggttgaattcgtcgagctgggccctgagcaacgcgttctcggttctgaggtcgcccgtctcgcgcagcagcttctcccgccacgtcgcctcgatccgctcggcggcctcatcgaggacggccttcacgccggatgtctcgctgattttcttttcgctcggattgtctgccatggtgcggcactccaatcaacaacggcatggctccgccatgccatatggctgggaacaatgcacggccgctgttgatttgtagtcatcctgcgatcggtgagttctaaaaggcgtctcaagtcatacgttatgcgttcacgcagggggtttcagttggagaaataccgcactcttatatagtagcgcactcggatttatcttctgacgcccaccaatccgcgttcacggaggatgcggtacaaagtcgatttcgatataccggtggcggcgcagatgtcggggatgggcgtttcccgcgcaaggtagagtttcacggcagcatcggccttgacgtccgcaatgcgcgggcggcccccgacgttgccaccatggttccgttttacggcgatgccctcggcctggcgctgcttgatcaggtcgcgctcgagctcggcggtgcaggcgtgagtgccgagaacgaatcgaccgaaggcggtatcgaggtcgaccggctgtttcaaggaagttagcttcacgccgagatttcggaacataaggtcgtagttcagcaattgcctggtcgatctggttaggcgctcccaggactcgactaccacttcatcgccggccttcatcttcttgaacagacgcttctgctgagttcggtcgccgtccttggcacccgtgaccttgtctttgtagatatggccatagggcacgccggcgttgaccaacgcctcgatttgcctatctagcttctgatccttcgtgctcacgcgagcgtatccgtatctggtcattttcagcctcctgccttgtcttttcaacgcggtctgcagactcatgccttcnnnnnnnnnnnnnnnnnnnnnnnnnnnnnnnnnnnnnnnnnnnnnnnnnnnnnnnnnnnnnnnnnnnnnnnnnnagacgtcggggccttgaatatgagcaataagatgcgtatcagtttgcgatggttcgatgatgggaccggctataccggtttttcgatatggctatggcagtttttatatatcgagtgagcacgaagggccagaaactcgactcgcggaggggcggcggcaacccgctggtgaagggagttgagttggcgggttcgatctcccggttcaaaaaatactcagtatactgagtgattttactcagtatactgagtatttaagaaacaaggaggtagattgacatgtttgagcgccatcaagttgccgtgatagcccagaggatgcgggaaacgaataatccgttgatgcaatttataatcgggccccgccaaacgggaaagtcgaccatgttcgtgcaggcgttgcaccatgtagacatgccctgtcacgtggccaatgcggacgatgttgtgaatcccgatgccagctggctgcaaatcgagtggcaacaggcaagaaacctcacgtctggaggtaaggccccggccgttttcgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgaccgggatcgccgggaggggacgccgctcaaggtcatgttgaccggatcgtcgtcgctgctgctgcataagggcttggaagaatcccttatgggccgttacgagctcattcggtcgccgcattggtcctatcgcgagtgcagcgaggcctttgacttttcttttgaagactacctctatcacggcggatatccgggtgcggcgccgctggtttccgatgacgcccgttggcgaaactatctccgagatgcgatcgtcgagccggcgatctcgcgcgatgttctctcgttggagaatatccgcaaaccggcgctgatgcgcgcgctcttttggctcgcggcgagctattcggggcaggagctttcgtattcaaaaatggtaggccagctgcaggatgccggtaacacggtcacggtcgccgggtatttggacctgctgggcaaggccggtttggttacggcgatccccaagttcagtgacaaggagctcgcaaagcgccgaagcaccccgcggctcatggtttatgacacggcgtttatgacggcgctcggcgataagggccgtgcagaatggctggaggattcggcgcggcggggtcatttggtggaatcggcagtgggtgcacgactgcttgcgcgcgcgccggaagagggttttgaggtcatgtggtggcgtgaaggcgtcaaagaggtcgactttgtgctgcgaagggatgatgcactgagcgccatcgaggtcaaaagcggtggagagtccggccagagcggcatgtcgacgctcctaaaaaagtatccgcgagccaagcggatcgtcgtgggaggagcggcggccggggcgtgcaccgtggaggattttctgctcgataaggtgccgctgtttaactagcctgagcaaattgagaaaatactcagtatagtgagtgaaatcactcagtgtactgagtattttgacttgggcgttggatgggtgctcggtcaccgcgtgcgatggtgaaaaccgggccaggccttaccagcggatatgcatacaggaggggcttccattttccatgtcccgctcatatcgtctgccagannnnnnnnnnnnnnnnnnnnnnnnnnnnnnnnnnnnnnnnnnnnnnnnnnnnnnnnnnnnnnnnncgacttcaccacgaagccaagtgacggcaagaccgtggccaacagtgcgcgggaccgtcaaatttcctcctgcattttctgacggtaccgcgtttcccgcatacgttttgagacgtttaacttaaacaataagatgtgtgccagcacagtccagtcgccggcattgattggagaggccatggggatatgcgagattgcggtcgagttcgatgagagcgaaatggctttgattcaggcccatgcgaacatctcgaacatgtccttttccgagttcgtgagaagagccgctcttgagaaagtcgaggatatggtggacatcgaggcattcaacgaaacgctgatggaagatgacggtacccgctactcaatggccgacgccatgtatatggccatgcagaacgagtagccgtttgcggtgccaagccgatcgctcgcgttgagcggcggcagcgcccgttggagcgatagttccataatctgtttcacgaattaccgtcaaaatgtttcacgcgctggtaggtgcaagcacagcttaagggcgcgcccaaagcacctcaaagtgccgccacacagttcaaggccgaaaaatcgacctcaccagatgcgttttaaggcgcctgaaagcagatgcccctaacgggtatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgatacagtaaataaaatgccccgcgaggaaaggaacagcatgagcgacgcacaggaaatcgttcaacgactcgaacgcgaaatggcacaacgagccgccgcagttgagaaggttgatgctttcaaggcacagctcaaccaagccatcaaggccttcatggtcgccgatgaggcggtccgctccctcaacgaccatgacagcgagatcgacgcccagattgcaactgccatcgccgagcatcttcgcgccatcgacctgctctgtcacttcggcatcgacggtggtttcggcaagaagcacccggttaaggagtactagccttcacatggccatggaagtaaagtagaagagggtcgaaccaagcagttcccgaacaattggcgtccggccagacacttcggttcggccctttctcgcgtgtattcctagaaagaaccgcgacatgcatttcgaaatgaatgcgaatcgcttttgatgcggtgcctgacggcacctatgatccgctcgcggagctcgctgatttatatatttctttttatcgcagcgcaaggacaagcgcctgtttacggccgagggcgacggcgagaagatccaggccttccaggcgagcgatgagcgcgacgagggccgctggattgccggcgagatcgaaaagttgcactccaagggcacgagctacgacgatatcgccgtcttctaccgaaccaatgcccagtcgcgtatcctcgaagatatgttcctgcgcgcgggcgtgccctacaagatcgtcggcggcacgcgattcttcgaccgtgccgagatccgcgacgtcatggcctacctcaagatgatcgtgaacccggccgacgaaatgagcgtcaagcgcgtcattaacacgccgcgccgcggtatcggctccacctcgattcaaaagatcgagcagctggcgcgcgataaccgctgttcgttcttccaggcctgcgagatcgcaacggccgagacgggcatgtttagcgccaaggtgcgcaacggcctgtcgagctttgtggcgctggtgcgcgagggccgccgcatggacggcgagctcaaggacgtcgttgagatgatcatcgacaagacgggcctgctgcaggcgttccgcgccgagggcaccatggagtccgagagccgcgccgagaacatccaggaattcctgggcgtcgccgccgagtttgaggagacgcacgaggatatcgagggtacgctcgagagcttggaagagctgcgtgcggctggcgttgccgatgtgccggcaggcgccgagcccgagcccgtcgtggtgagcgcacctgcgcccgagcccggaccgtccgcacccgcatcctcgtttgaggcattggtcggcgcccgtgacgccgctggctccaatccgctcgacagtctggcggctccggcgctctctccgcaggatgctctggctgccgccatcgcgggcaacgcgtacgccgcgccgacggagctgccggccggtgccgtgcatgctgacgagattgagcgcacttatggcccgcttacctgcaaggcactgcccgcccttatggagtggctggccctgcgctccgacctggactccctggccggcgagacgcatgccatcaccatgatgaccatccactccgccaagggtctggagttcccggcggtcttcgttgccggcatggaggagggcatcttcccgcacgtgcacgactttggtggcagcgacgatccgggcaagctcgaggaagagcgccgcttggcatacgtcgccatcacgcgcgcccgcaagcgcctgttcctaacatatgcggcaacgcgccgtacctatggctcgacctcggccaacccgcgctcgcgcttcctcaacgagattccgtttgaagatatcgagtttagcggtatcggctctgccggttttgagggcacgggatgggagaagcgcggcgaccgtcacggcacttttggctcgggcatgggttcggatatgtatggcggcaaggtgttcggttcgcatacgcgctcgaccggcggctccggatcgcgcggcggatcgagcttcgacgatttctttggcggcagcagctatgggaccgagcgccatcgtggggtctcgcccgacgccggccgtgttgcctcgacctttggctcgggcgcgccgcgagccaaaaagccgtcgtccaaggtgtcgccgacggtggagcgcaaagtcgatcgcgccagcgcgtcgcaggactttgccgcgggcgataccgtgagccacaagacctttggcaccggtaccgtgatctcggtcgctggagacatgatcgaggttcaattcgaaaagaccggccagaccaaaaagcttatgaagggctttgcgccgatcgtcaagctgtcgtgatcccggcggacctgggcgggcgtatggggtaacatcgcctgctcgggcagtcctgcgcaagacggaggccacattaagtggcctcctttgcgttcaagactttagtctgctgggcgcgcagcggccagctttaaaccacccgctacgcgggtggagacaaacggctttacaaagccacccctccgaccgatattgacgattgttcaggccgtcaagaattcgagtcgaaggggtggtcgccatggcccagaaggcctacagcctttcccacacgaagtggatgtgcaagtaccacatcgtgttcacgccgaagtataggcgcaaagtgatctacaaccaaatcaggagcgacataggggagatcctcaggaagctgtgcgagtacaaggggatcgagataatcgaggggcacctgatgcccgaccacgtgcacgtgctgctggcgatcccgccgaagtacagcgtcgcgagcgtcatgggctacctgaaggggaagagctcgctgatgatattcgacaggcacgccaacctcaagtacaagttcggcaacaggaagttctgggcggagggctactacgtgtccaccgtcggcctgaacgaggcgacggtcgccaagtacatcagggagcaggagtcccgcgacatcgcgctggacaagctgagcgtgaaggagtacgaggaccccttcaagagggggtgaccccgccggttcgaccggcgcgccacgggtcaagatgcactaggcctggacgaagtccgggcccgcgcctttagacgcgagcccggggcccgtgggttataccctaagagcaaaccaccctttttaagggtggttctgatttgcttcgcgccatgtgggggtgatggcgacgtgcatttttgcgagtattctgcaatcgaaggcccctgcataccgacctcgggcaaaaaatcgggatttctcgatgttttctacgaatgatgggcggggttatgggccggcagcgtttgatttgcagggatatttgcgctctttggcatttatcgcggcgcccgaagcccttggttatgttgaatactcctaaaaatgcacggcgcttagagggggaccttcgcgaaaaaggaaaccgccccgtcgaagtatgcattcgacggggcggtttatgcatttggccgattaaagatgcgctgtcaaactactagaacttgacggtcggggcctggcgggctgcttcggcggcctcgaagccctggcgctccttaaactggaagatgccggcaaagatgacagccgggaacgtctggatggcgttgttgtagctgagcacgcagtcgttgtagctctggcgtgcatagctaatcttgttctcggtatcctcgagcgatgcctgcagctgcgtaaagttggtgtttgccttaagatcgggataggcctcggctacggcgaagagctggcgcagcgcgccggtcagcacgttgtcggcttccatcttggcctcgggcgtggtggccttgacggcggtgttacgcgcgctgatcacggcggagagtgtctcctgctcgtgcttggcgtagcccttgacggtctcgaccaggttggggatcaggtcgttgcgacgctgcagctgcgtatcgatgttctgccaggcgttatcgatgcggttacgcttggtgaccatgttgttgtagatgccggcgatggcgcagacaatcacaatgacaacaacgatgccgatgatgacggtaatcatgatgtctccgtttcgaatggccgcggcggcatgcgccagctgccgttggtataacgctactagtatacccgcaacgttttgccgtgccgaactttccggtaagcgttatgttttcggcggggtcggcaccggggtaaaacgctcgaggtacaggtgtaagatatgcgacagattgacgagtgttgtctttgccctgaggatggcgataccagtggaccttcgcattaagaaaacctaccgtgccctgttcgatgctttcaccgagcttctcgaggagcatcgttttgaggacctgacggttgccatgctgtgcgagcgtgccatgatccgccgcacgacgttctataagcatttccgcgacaagaacgattactttgccttttatgtcgacgagctaatgtcgggactgccgcaaaaacggaccggtaaggggggcgcagtgtcggccgacgacgtgcgcgtgcttcgccatgaggtgttcgccgatgccatggacatgattctggcacatgagcagctcatggataacatcctggagagcagcatgtcgggcatgctgaccagcatgatttgcgaccgcattgcccactccattcgcgagcgcgtgatgagcacgcttgannnnnnnnnnnnnnnnnnnnnnnnnnnnnnnnnnnnnnnnnnnnnnnnnnnnnnnnnnnnnnnnnnnnnnnnnnnnnnnnnnnnnngacgacatcggagtttatcgccggcggcattattcgactgttcaccaagtggtgggaatcgggtcacgatcttgagagccgacccgagattgccgacgtggtcgatgcgctgttcgagcggaccatgacgccggtgcatcactaagaatggcggagagagggggattcgaacccccggaacgctctcgcgctcaacggttttcaagaccgccgcattcaaccgctctgccatctctccgtgagtcgtaatgatagcatcgttttgaatttgcaacagggaaggcgaacgatgacgatcaccgaaatcgacgagaagttcatgcgcgaagcgctggccgaggcgcgcgctgccgcggcggtgggcgaggtgcccattggtgccgtggtggtgtgcgcgggcgagatcgtcgcgcgggcgcacaatcgtcgcgagctcgatcaagacccttcggcgcatgctgagtttgcggcgttgtgcgccgccgctcggacgctcggccgttggcgcctttccgactgcaccgtctatgtgacgctcgagccctgctgcatgtgcgcgggccttatggtcaacgcgcgcgtgggtcgctgcgtgtatggtgcggccgatgccaaggcgggcgcgctgggttcgctgtacgacctcaatgccgattcgcgcctgaaccatcgctttaatgtgacggccggcgtgctggcggacgagtgccgcgaggtactgagcagctattttgccggtttgcgtggcgcggatggcggcggttgcgggtccgatcttgaggcgcacgccgctcatgccgcggcgctggttgatgccgacgaggttgctggcgcggcggtcgaccttggccccgtgcagcgccggccccgtcgcgtgctgctggcgatcgactcctttaagggcagcgtgtcgagtgcgcaggcggagtctgcggttgccgagggcatgcgccgtgtgtggcctgatgccgaggtacgcgcgttgccgctggcggatggcggcgaggggacgctcgatgccgttgccgcgtgcggcggcgagatcgtgacctgtgaannnnnnnnnnnnnnnnnnnnnnnnnnnnccccctgggtgatcgcgtgtccgcccgaatgctgctggatggcgcgcgcgcgtctgcggtcatcgagatggccgaggccgcgggcattgggtattcgccttgcacggagtcggcggcactggctgcctcgacctatggcgtgggcgagctgatgcttcgcgcggttcgcacgggggcgaagaatctatatataggactgggcggcagcgccaccaacgatggtggtgccggcatgctacaggcgttgggcgcgcgtcttgtcgacgaccgtggctgcgatattgcgccggggcttgcgggccttgagcaannnnnnnnnnnnnnnnnnnnnnnnnnnnnnnnnnnnnnnntggccagtgttgatctggtgccggcggcgcgggcgttggatggcgtgcgtatcgtcgtgctttccgatgtcgagaatccgctcgtggggcgccgcggcgcactggcggtgtttggcgggcagaagggcctgccgacgggtgacgccgaggcagtgcatgagtacgacagctggatggtcggctatggccgcctacttgatacggcgattgccgaggctcgagcgcgggagttgctgcgcgtgcccgagggcgcgcggacgtttggttcggtactcggcgtgccgggcgcgggcgctgccggtgggctgggggcagccttgctggcacttggtgccgagctgcgctcgggcgtggagacggtgctcgaccttgtggggtttgacgagcgcgtgcacgatgccgacctggtcataacgggcgagggcaacatggacgagcagtccgccgccggtaaggcgccagtgggcgtggcacgtcgcgccaagcgccatggcaagccggtggtcgccgtcgtgggcggtcgcgccggcaacctggatgcggtatacgagcaaggcgtcgacctggtgctgcccatctgccgcaagcccatgcccctcgaccaagcgctcgatccgcaggaagccacaaccaacctcatctgcgccggcgagtcagccgcccaagcctacgacctcgcccgcatctaaaacgcatccctcgataagttgcggtgaaatagctcctgtttaacccctcaagacggccaaacgggaactattccaccgcaacttccccttttggcgcaaattaacctgaccggcgagctcggggcgatggaggcgctcgatttccaccgaaccccgttcgcaggcaatcgttaagcggctttcatatgctgctttgccgtcgcacaccatatgaatgggtataccgccgacactcatatggatctcatcggcccaatccacgcggccgcctaatacgtcacgccagcgaacttcacgagacgaaacatcgcacgcacccgcaagcagatcctcaaaccacccgaccgcatagcagcccatgtcatatagacagccaccctgcaacggatcgagcagannnnnnnnnntcgaaggggactcaccataatcgagtttttgcacgctttcgatcgagacgatacagccgagctcgcccgacgcaagcaaacccttcacgcgagtatgcatcggacaaaaccgatttttcatcgcctccataaacggcacaccgcactcacgggaaacagaggcgatcgcatgggtctcttcttcattcaaaacggccggcttttcgcacagcacggcctttcccgcgcgcagtgcccgacaagcccaatgtgcatgcatgccatgtggaatagccaagtagattgcatcgacatcgggatcggcaatcaacgtatcataagccgcatcgccgctatcgccagccgtggcataactgtgcgcggcatcaatcgaaaacgcccgccaaaatttctcgacatgtgcaggagtgcggccggccgcagccaccagccgtgcctcgtcgaccttcttgagcgacgatgcaaatcgatgcgaaatgtgcccagcgcccaaaacgccccaacgaacctcacgcaaatcatcacatgaatcccgatagcccacgacagcccccttcagttgcggtggaatagttcctgtttaagccccattctgccgcaaacaggaactattccaccgcaagttataaaagggtcatgaggagcgcgttttgccgaaggccttgagcaccgccgtcacggggccaggctgaaaacggcggcgtacgtcgtccaagcgcccggggatatcgatgtgctgcgggcagtgacgtgcgcatttgccgcacttgacgcaattgctcaccagcttgggctcgttcgtccgcaccgcgctcgccgtaaagtattgagacagccccgtaaaccaactatgcgcgtaactcgcgttgtaggcggcaaagcagccgggaatattgatgcccttggggcatggcatgcagtagccgcaccccgtacagggtacgcgattcgatttctcaaactctcctagcacacgcgcgatggtatcgagctgctctgtcgtcatcgaatccggcagcgcgcgatccgccagcaccgcgttctcgtccacctgcgcggtatcggtcatgcccgaaagcagcatcgtgatttgaggatggttccacacccacgaaaggccccaagcagccggcgacttcaggtacggatcgcgtacgtcatcgagcacggcgcgggcccgcggaggcagcttgcccgccaggcgtccacccaaaagcggttccatcacaaacaccgcgagcccgcgctcggcggctgctataagtcccgccgtccccgcttggtagcgctctccagcgtagttgtactggatctggcaaaaatcccagtcatacgcgtcaagcatcgtgaggaagtccgccgcactgccgtggtacgaaaaacctatctggcgaatacgccccgcagccttttggtgcgcaatccagtcctcgatacccaacgccaccacgcgctcccactgggcgggcgaggtgatgttgtgcataaggtagtagtcaatatggtcggtccgcaaacggtgcagctgctcgtcaaaaaagcggtcgaaatcctccgcacatttgcacgaagcgtgcggcaacttagtcgccagcaacacccggtcgcgcagccccaagcgctcaagtgaggcgcccacgcacacctcgttaccgggatagagatacgcggtatccagataattaatcccctgctccaccgcacgggaaatgatggcatcggatgtcttcgcatcggggtgtcccggcgcaccgggaaatctcatgcagcccagacccagagcggatattcggttaccacttttggggtcaacgcggtattgcacgccccctcctttcgccatcagcaccccggcaagacgaaacacaatggtcacgccatcgaaacacattggaatcgcaatcgagaacgtatcgtaacgtagcagaaatcgagctgtcacggcaccgctttaacatcagcaaaaagcccgatgaaaggagccgcccatgcccgcgctcgacctttggaacctcgcctcccagctcaaaagcaacgattatcgctgggtcgacctcacccacacgctctcatgcgacaccccgcactggtttggctttaagccatttgagtccaccaagctcttcgactacctgcccggcacgcccgaggacatgctcgcgcccatgcgttgcttccagtattcggtcgcctcgcagtacggcacccacgtcgacgcgccgcgccacttccatgtcgagggtcgttcccttggagagattgaacccatcgagtttatgcatccgctctgcgtgatcgacaagcatgaggagtgcgccgcgaatcccgactttatcctgaccatcgaggacctcaaagcctgggaggatgagcacggtcgcattcccaaggacgctttcgtcgccttccgctccgactggtccaagctnnnnnnnnnnnnnnnnnnnnnnnnnnnnnnnnnnnnnnnnnnnnnnnnnnnnagcgcgacatcggcgccatcggccacgagccggctgacaccgacccggcgagcgtgaccacgcgtgaggacgcctacccctaccccggcgaacagtacatcctctcggtcgaccgctatcagatcgaggtcatggaccatctagacgagcttcccgccacgggcgccgtcatcttctgcaccttccccaaggtgcgtgatagcgtcggatatcccgcacgtgtctttgcggtctgccccgcgtcataagttcccatgcgtttgttcttctaaatacggccatccggtgcacgcgacatggcccggcggcatacaatccatcaggcgccccatacgcgggcgcctttttatggggagatgattcacatgcagatcaacaaggtcgccttcatcggcaagggcggcgtgggcctgctctacggcagcatgatcgcccaagcgctcggcaacgacgccgtcgaatacgttatggacgacgcgcgctttgagcgccacgcgggtgatgcgctcaccgtcaacggcaagccctgcgcgctcaagtccgtccgcgcgagcgaggcgacgcccgtcgacctggtcatcctcacggtcaagacaaccgggctcgatgtggcgctcaaaaccctggaaagcgtcgtgggacccgacacgctgatcgcgtcgctgtgcaacggcatcacgagcgagcagaagattgccgagcgctttggctgggagcacaccgtccttggtatctgccagggcatggacgccgtgtttctcaacggcgcgctcacctttaccaatgcgggcgagatccgctttggtgcggccgccggcaccgaccccgcgaccgtcaccgctatcgacgggctctacacgcgctgcggcatcgcccacaccgtcgaggacgacatcgcccaccgcatgtgggcaaaacttatgctcaacgacggcatcaaccagacttgcatggcctacggcggcacgtacggaagtgccacggaacagggctccgagcagctccgcagttttgtctccgcnnnnnnnnnnnnnnnnnnnnnnnnnnnnnnnnnntatcgagctcaccgaggcagacctaacgcagatggtgcatctcatcgaggggctcgaccccgccggcatgccctcgatggcgcaggaccgcgtcgcgcagcgcaaaacagaggtcgaggagttcgcgggcaccgtccgccgcctcgcggccaagcacgatatccaggcgccgcagaacgaatggctctatcggcgcatccgtgatatcgaggcaagctggtaacgccgccgcaccgcatccaacagtctcaatagcaaaaaccgccgcaaagggcactccccttgtggcggttttcatgttcagccacggccaacagtcattttcgcaacagctagagatgcgactccggaacctcgtcctcatcgtcgcgacaaaggacaacaccggcgcttcccagcagtgtgaccgcgatcagcgcgccgaccacaataggagcagccccgcacgagccctgcatgcctgcgacaaacnnnnnnnnnnnnnnnnnnnnnnnnnnnnnnnnnnnnnnnnnnnnnnnnnnnnnnnnnnnnnnnnnnnnnnnnnnnnttcatgagaccacttcctccacgagaaagaccttatttctcatgaaccagtgtgccccgcatgcatacgcccagcgtaccgccacggtaagggctctgttaactcaaacgcacataaagaaagggcggctttacgttgcctaaaagctcagtaaagacgcccgcccatcatgtgcctattttgctctgatggcagattaccaaccggtgtagtagtcggtggttccggcggcgcagccggagtcatagaccttgcaatcacccttggagcccgtaaaggtcgagccctgggccatatcgcccgcggcaacaacgtaatagccgtcggaatcgcgccagaagccctcagaatcctgagtccattcgcccgtgcgatagtgataaagcacattgctgctgtaataggtctcgcggcgcccgttgtagttattgacacccgcagagcgcgtcaggcccgatccgttcgcgtaggacgcggcagacgcgtaggacggagtgtagccggcgttgtagtacgaagcctgggcggcctcggcagcctctgcctcggcggcagcggcctcgagcgcttcgcgcttggcattctcaagcgcagtgcgcagctcatcgagctcggtcgacttcgcgtcgacctcccccatcgtcaaaaggctgcccgcaccatcgatacaaccctgcagcacagcgcgctcgtcatcggtggcatagtcaccatacatgtttaggataatctgagcgcgcatctcaagggaatcgcgcttggcctccatcgaggcgttccactcctgcatggaaccataaccatcgccgcgataatcaacgggctgtaccagcgtcgtctcggacggcgtagatccaaccgtatcggacagtgttgccgcgtgggcatcagttgtgccggcgcccgccaaaagcgccacggtcagagcggcggaaagggcggcggctttcggttttcgtgaatcgatcctcatgtagctggaaagtgcgtttttgctgcgtttgagctgcgtgtgattcgatcgcgctgcatagtacctcgagcaaatcgcgacctgcggttttactcaaaaggcgcacgtcaattgcgtaaaactcacatcctctcaacaggagttttccacaactcgaatgcataaagcatgccaaaaaccctgtaatagcgcccttcctatgcaaaaaaggcgcctgcgcaaccattgcttgcgcaggcgccttgagcaggcattttatgcagttatacctatcgagtcgcaaggggtccttgcacaagtcgccttannnnnnnnnnnnnnnnnnnnnnnnnnnnnnnnnnnnnnnnnnnnnnnnnnnnnnnnnnnnnnnnnntgatgttctgctcggcgagctcctcggcagagagctgggagtgcgtggtggtagccgggtgcacgacgagcgacttgacgtcggccacgttggcgagcagcgagaacacctgcagatgatcgatgaacttccaagctgcctcctggccacccttaatctcaaaggtgaagatcgacgcgccaccgttggggaagtacttctgatagagctcgtgatcggggtgctcagacaggctcgggtggttcaccttgacgacatggctgtcaccagccaggaactcaacgaccttcttggtgttctcgacatgacggtcgacgcgcagcgacagagtctcggtaccctggagcaagatccagnnnnnnnnnnnnnnnnnnnnnnnnnnnnnnnnnnnnnnnnnnnnnnnnnnnnnnnnnnntctgcgcatacttgccgctcgccttccagtcgaagttgccgccatcgacgatcacgccgcccagcgaagttccgtggccgccgatgaacttagttgcggagtggacaacgatgttggcgccatgctccagcggacggaacagatacggggtgccgaaagtgttgtcgacgacgaccggcaaactatgcctcttggcgatctcggagatggcgtcgatgttgggaatgtcggaattggggttgccgagcgtctcgaggtagatgaccgtggtgttgtccctgatggcaccctcaacctcttccaggttatgagcatcgacaaacgtggtctcgacgccaaactgggagagcgttacaactaaagcaacccggccgggacgaggggtgacgcaaaagcgtcgcccctcgtttttaaccatgtcaactgaacctggttcaggcttcaatgcaagaagaagcaggccgaggtccagatttcggacaagaagagggcgctcgcgcgcgaggcacacaaccacgcgctcatggtcgccggcgggctcatcgtgaaccacgcgccgggcggcaactggaaacgcatcgactgggacaggcttgcggcgtgaatcgaccgctacggatacaaaatcaccggctccacgcagcacggaatctggatccgtaacctgtcgtagcccagatcaaaataccggttgtttcaagaaatcctctaggaagcgtctagatagaggatttctggaaatgcaaataacaataatttagcttccgagcgtatcgaccggagcaacaacgatgccttcgctagttacgtgagccggcataccaaacccgatgacgatgagtttcgccgcaggcggcctctccccgcgatcgaccagctttcgctcaagtcgaagcagattttccactgcctctgggacttgggggctcccgagcttaacctcaacggcaacccacgagccgtcacgacgatggacaatcgcgtcgacctctaggtcgtcagcatcgtggtagtgagatacggtcgcatcgctggccgccgcgtaaaccttgagatcgtgcagcacaagggattcgaagagcaagccaagggtcttcggatcggatgacaacgactccggatccgcaccgatgagggcgacggcgagcgatgggtcagcaaggtgccgcttcgcgccctgccgcaacttcaccggcgacctgagagccggatgccacgcggggacatcgtcgacgatattgatacggcgcagcgcgtccatgtaactggtaatcgtattctttgagacgtcaacacccaaatccctttcgatggacctcatgccggcaagagtcgattcattgcgtgcaagcgacgagagcaaggcccttaccttaaccgggtcgcgtttcactccatccgccctcgaaacgtcagactcgcaaacaccgtcaatataggcggcggctatccgcattgcgtcggcagttgtcttaccgaccgcttggggccaaccgccgcggcagagcaaatcagcgataccggcgataccgtcgatggatccgagtgacgccgcaacggaatcgccatcgagcagcgcaccaagcgagaccgctcccgacgaaataccgagctcgaaaagcgtcatggtatccatccgcaaacgggcgattcgacccacaccgctgtgcatcggctggttctcggctcgcggcgtcgcagatccggtgagaatgaactgtcctggctcccctcccctgacatcgcattcgaatcgcacggcatcccatagcttcggttcttcctgccattcgtcgacaagcctcggggtcggtccgacaattgcttgggccggatcgagacgagcgagttggagggccgcaaaaccgccagatgggtcggagagagataacgatgactcggcaaatctctgagctgtcgttgtctttccacaccatttcggcccctgaatgagcactgcaccaaaaatgccaaggtcgcgctcgaccaagcagtcaacacaacgtcctatatacctatccatcggctttccctccaatcattcatttgaaattatagcgtctatctgcgtcgttgggacaaataacgattacttattgggacgattgacggtaatttattgggacgattgacgatagctcgttgggacgatttccattttcttaaggcgctaatcaacgagacccactgtgaactatgagacggnnnnnnnnnnnnnnnnnnnnnnnnnnnnnnnnnnnnnnnnnnnnnnnnnnnnnaatttagctgacgcctctcatgagttcagcaatgctgatttgaaatccatcggcaatcttcttgagatttgagaggctgacattacgccgcccgacttcaatgctcgcgtagtaggaacgatccatttcaatcaaattggcgaactgctcctggctgcacccgagtccagcgcggagctctttgcatctcatgccgaatgatttctgaagcgtcttcgtatccatgacaaaaagagtcatggattgttgtataaaagcaaacggactatatacaacaatcccagttaatgcgcataattatctctattggaaagcactctgatgcccagtcggatagggcacggaaaaggaatggaacagcacaatgactcagggaaatcacttcgccgcactgccaaacaaaaagattcacactccgaaggggatcgcgcgtctgaccgtcaccgcggcgaccatggccgccatgaccggatcgagcctcatctcaccgttcacggcattcgcccagaccggtgacgggggcacacagcaccccgccgtgatgtcgccgatcgccgcccacgccggcgcggcatccggtaccggcgcgaaatccgccgcacagaccatcgcggacctgcagaaggcagtcaacgaggcgaaggcgaaggaggacgccgccaaggcagcctacgatgaggccgccggtccctacaacgaggcggcttccgcccgcgaccaggccaaggcatcctacgattctgcagtcagcgccggcacggcagccgaccgagcggcaatggacgagtacgcccgtcaggtcgcagagggcaaggacgccgccgatgccgccggcaaggacctcgagcaggcgaaggcgggtctcgcagacgccaaggcggatgcgtccgagaaggacgaagcgtaccagtccgccctcaaggcggctcaggatgccaagaatgccttcgataaagccaaggcagatgctgtaagcgccaccccggaggcaatcagtgccgccgagcaggccgtgcgcgacgcccaagatgccgtgagcagggcacaggccgacctcgccaacgccaacgcgacgcttgccgatgcccagtccaagctggttgcggcccagtctgcaaaggattccgcagataccgtcctcgccgcagcccagcagaacaaggacacggcggatgcgaaggccgcagccgccagcgccgcctacgagcaggcgaaagccgacctcgccgcagcggaggccggtgccagcggtccggagtacgatgcggcaaaacagaaggtcgcggacgcagaggcaaccctcgccgccgcacaagcggcacagtcccagtgcgagtccgagctcgagcaggtgcagtccgccgcggcaacggcacagaccgagctaaatgatgcccaggcatccctctctgcgaagcagcaggccgcggtcgatgccgcgtccggcgtgaacgacgcccagtccgcactcgatgccgcgaactccgacctcgatgcggccaagcaggcgaacgccgatgccatcgccaagctggacgccgcgaagcaggctgtcaaggacgctgagtccgccaaggcagccgccgacgaagagcttgcgaacgccaagaccgcaaaggataccgcagacgccgccgtgaccgccgcgcagcagaaggtcgacgaggcacaggcgaaactcgattccgccgacgcgcaactcaagcagggagccatcggcttcttccgtgccatgggtgccgatgacgcagtcaacatcatcctgaacgccaaatatgtcggaaagaccgaagtcggcaactccaaggacgccacgtcccttgataacatgctcaatgcgatcaggtggatgaagtccgtcaacgactaccgcaagtcggtcggcctgtccgagctccaggtcacctacaagctcatcgccggagccattgcggatgccaactacagtgacactgtgctcgatcatgcccgtcaatatgattttgccgaaaacctggcatggaattacggaatcgatnnnnnnnnnnnnnnnnnnnnnnnnnnnnnnnnnnnnnnnngctttttcgacaaggcaacggaggccctttatggagtcaccggtcttgtcggcaaggatgcctatgatttctatgcaaagaacggtgtcgcaatcaaccattggattgcagacaactgccactgggagaacggcagtagcggcaccgtcggccattacatgaacatcatcaatcccgaactcgccgttatgggaatggcaacctgcaccaagggcaccatgtccgggcttcagacgcagtgctacaccgcagagatctccggctggtccggctccggttggaacacgaaccccatctccgtcgacgagtacgagcaaaagctgacctcctatatcaacggcctcaagaacgccaagagcgcactcgacgtagccaaggccgatctcgcatccaagcagcaggcagccgccggcgccgccgcaaccgtccagcagaagcaggacgcagcggatttcgcacaggcagacgtcgatgccgcgaagcaggacgtcaccgatgcccagcgtgccgtcgatgccgccaaggctgatgtcgccgccaagcagcagggcgtcaccgatgcccagaccgagcttgatgcggcgaaatcggacctcgatgccgccaacgcggcagtcgatacggcaaagtcgaccgtccagcagaagcaggttgcttttgatgctgccaacgcagccgtaacgaccgtacaatctaagttggatgccgcaaaggccgacacctctgccaagcagcagagcgttgccgatgcgaacgccgatctcgcgaagttcttccaggacgtcgccgacgccaagaaggcgctcgatacagcaaagagcgtccatgactcggcggtagccgatcagaccgagaaagcgaccgtcctcgccgccgccgagcaaaaggcggacgccaccgcacgcgccctcgcggatgcccagcgtgccgtcgatgccgcaaagaccgacaccggcgttgccgccgacaggcttaccggctcccagaccgatctcgatgacgcacagtcgaacctcgacatcctcaccggtcttgccgcgaagctcgcagaggcacagcagcgcgagcaggatgcagtaaaggccgtcaatgacaccaaggccgccctcgatgccgcgaaggcggataccgccgccgccgagtccctggtctccgccgccgaacaggcgaaggcgctggcagacgccaagctgtcgaagctgaactccatcgatgccggcgcggcgatcgcttccggccatgatgtgaacgcggatgacgccctcaacgcgcttttcgccgcagcagtcgaggcacgtgccaaggtcgcgcccgccaaggccatcctggacgagaagcaggccgcggtggacgagctccagcccggctacgatgcgacactcaccgcctacgagttggcgaagtccgaccgcatcgcaacggagcagaagctttccgatgagatcgcacgacaggaggcagaggaggtcgcaaagcagcaggcggcatacaccccgaagcacctcgccggcacggataccgctaagcccggcagcctcgcccagaccggtgaccgcgcgggactcatcggcgagacgttcgtcatcggcggtaccgtcctcgtggcagccggcgtattcctcgatcaaaagaagcgccgcgagcagatgtagtgcaaatcgcataacgactcggaaaggggaatcccgcaaaagggattcccctttttcgtctcgccagccacggttcgttgaggcagcttcagattaagggccacagattaaaccgatctacaactgtgaccatatgactgtgcgcacatgttagcatagtcatatggtcacctatttgcagctgcgattatgctgcgacaactcaaccgttagcgcttattaaacagccgaccaaatcctggtttgcccagtgtctggcgcatctgccccacctgaatctccgtctccacgccatccttgccgaagacgttgnnnnnnnnnnnnnnnnnnnnnnnnnnnnnnnnnnnnnnnnnnnnnnnnnnnnnnnnnnnnnnnnnnnnnnnnnnnnnnggtcgaagcgctggcagccgacctggttctcaagatggatctgaccatcggatccaaagacattctggtacatgtctgcctcctcgcaagaaactgtcgatcccaagataacagacgggcgaatccggcgcagcagacgctcgataatacatgaccatgttaatgtagtcatatgctcacgtattacaagctgggaccttatgtattagagctcgaaccgcgccgccgcgtcaccatgaacaccgacggcgagaacatcgactacttcaaggcggaggccgcccgcacggacgccccctatcaggtcatcatcaacatgtacctgacggagtcccgcatgcagaagaggcacctcgcggtcgcgtaatacaaataggtaagatcccacgcgtgtcacgcctcgccgcaatcggagccttccgatctgtatggtcttgccaaaccagtcaaaatcgccctgctttttaatgcggaattcctcgcacggcttgccgccgtgtgcttccagatactggttcacacgcgtgttccataccgtgtcggccaccagatgcgaccagacgcccagcgttaaatcgagcagcgactgcgccacatcttcggacgcaagcgagaactcacaggcgccgggaccgacaaccggctcggcatccctgtagcgctgaggatagtgcacgcggttcagtcgctcgcgctcctcgacaatcgaggtagcctcagcaggttcgcccgcgggtgcgcctttaagcagcggcgccacatagnnnnnnnnnncccagaactcgtgctcgcgcggcttagggataggctcgggctttgcaaagtgcgtaatgcgatacggaatgggatcggcgatgccagggaccatatagcccacgaagatatccggaaccacgcagccaaacaaaaaggcattgcggtcgcgcacgctatcggcaagcacgctagcacgtgccagcaagcgctccgtttgagcgatatgaatgttccaacttggcatagccacccccataaaacctggttaactataccatcacggcagagtcgcacaggcggccatacataccctacgcagcaactattccgcagcaccgctttcggttccatacgacggcacgggcgcctcgaccacatggtgatatcgatcgatatagatggcacgggcctccaggcggcgcaccaaatcttgatggtgcgtactcatcaaaaccgtcttaccggcagcaacgtaggccagcaaaaagttgactacgatgtcgcacgagtcctcatcgagcccgttggtgggctcatcgagcactaggatatcggggttcatcgacaccaccgcagccagcgcaacgcgcttcttttgcccgcccgaaagctgatagggcgaggcatcgaccagatcggcaacctggaacagctccatggcatcgcggacgcggcgctcgagctcgtctgtcggcagccccatctgcgcggggccaaaagcaacttcctcgcccaccgtagcgcagaacagctgggcgtcggcattctggaacacaaagcccacgcgctgatgaaaacgctgagcggctgcggaatccttgagatatgccgcatcgatcacgtgcccgtcaaacaggtacgcacccgcgtccgctagttcaagaccgttgataaggcgcataatcgtcgtcttaccgcagccgttgggaccgagtagggcaacgagttcaccacgatcgacctgcagcgacacaccatcgacaaccgtatgccccgcataggagaacagcacgtcgcgaaactcgatgagcggcacgctcttggcgccagtagcaccgctcgcgcccatcacgccattcgtatcgtttgccaaaacgtcgcccttccctatccacatcgacggctcggccgcccgcgctacagcaccgcgcacaacacggcgagcagcaccacgacgaccgcatagaccgcatcgcgccagccaaagccgctccgcgcgggagtcggatacgcaccggcaaagccacggcaaagcatagcctcgtccatcgcgcggctgcattccatcgccttgataaaggtcatgcccatgatacccgcgatcgaatcggtacgcgaaaaacccgcaggcgcacgacccacgctgcgcagcatgaccgattcggtcagannnnnnnnnnnnnnnnnnnnnnnnnnnnnnnnnnnnnnnnnnnnnnnnnnnnnnnntcaaacgtaaagatgacctcgtcgggcagctgtagcgtcttgagcgccgccgacatgcggctccaggtgagcgtccacgaaacgcccagcacgaacgacacgttaatgaacgtcttgagcgcgatcttgagcatggcgcccgcggcagaagcgcccagcagcagggcaggcagtgccagaaccaccgcaagccccgtggcgccgagcgccggtacaaaggtcgcacgcagcccgcgtacggggcgcacggcaacgagcaccagcgcgatggccgccatcaacatgaggtacagcgggctctgcgtcagacacacgcacagaacgcaaacgaacatccccaccaggcgcaccggagccgaaacgcaagaaagggcgcggtcgaccatcgacccgccctcgtgcgcgcctccacccaggcgaacccgctcaagcaggctcgccaggtgcaggacattcttttgcatcacacgatgccgagcccccgcgggctcgtaacgctcctcggccgcaagccaactaggcagctcggctattgccatgagcaccgctttccttgaccgtcagcgagaccaggcggaatgtgatggtgagcaccgccacgccaatcacgcccgaaagaatatacatcgcagcctggccggcaaagccaaggccctgctcctcggaataggcctgcagataatcgcccgtgggcagggcgtcggcaaaggtcgggtgtcgaggccggccgaagcctgcaggctgtcgtcgccagcctcctgaacggcggtcgcggcgccctcggcgtcccactcaccccaggcgtcaccggtggcgagcaagccgagcggcgtagccacgacaagcacggcgaccagaatgagcgtgggaatcagggaagtcttcttggcggtaccatcggcggcaagctggccatcgacggcctcgggcccgacgataacgctcggcgccgtcttcttaatgaaaccgtagatggcggccgtcgccacgccctcgaccacgccagcaaccaacatatgcggaatcatcatggccggaatggcaacggacagcgggaaggggcagtacagtggagcgcccgaagcgttggtgaagagcatcggctgaataccgaactcgatcgccgcgcacagggccgccagacacaggccgacccaaccgctcacgatggcagaaaccgaggtgccccagctcttgtcgtgcagacggctgttgagcgcacggaacacgatagcagcggtaaacggcagcacaaaggccatgttaaagcagtttgcgccaaaggacagaacgccgccgtcgccaaacagcagcgcctgcagcgccagcgcgaccgaaaccgcgatggcagcggcctcgggacccagcagcagtgcgatgagcgcgccaccaacggcgtgaccagtggtgccaccggggagcggcacgttgaacatcatgagcaagaaggaaaatgcggcgcagatgcccaggaacgccatatgctcgcgatcgagcgtggcgcgtacctttttgatgcaatggacccaaacgggcaccatcgccaccgccatgacggcatcggtctgcggggacagatagttatcgggaatatgcatgagccctctcaatcagaacgttgcgtgttacgtttccaacaatccgtaacaccgactcagcatactaacaaaaaggcgcaccgcccacaacgcagcacgtccttgcaatacgtacgttattaacccaggtccacgcaccgcccaataaagggcccatgcactcccaactttccggtcacccggaagaaggtgcggtccgctcgcaacaaggttaacgcaggaacccgcccccgagaggggttttctaaggcaacatcccgcagccgcgaagcggcgaggacgttgccgtgaaaaccccgcagggggcgggttccgaacagcaaagattacgagcggacctcgccgtttacgcccttgcacaccttggtgacgatcttctggtgcgccttctcgacctcttcgctggtaagcgtgtggtcgtccgagcgatacgtgagcgcgaaggccatggacttcttgcccttgccgatgcggaccggatcgcggtagacatcgaacaggcgcacgccctcgagcagcttgccgccggcgctggtgatgcgacgctcaaggtcctcgcaagtcacggcgttgtcgaccacaatggcaagatcgtgctcaacagccgggtactgcgagaactcgcgatagttctcttggttgcgggcgcccttgatcagcttgtccaggtcaagctcaaaagcaacgacaacctcgtcgatgccgcaggcctcgcgcgcctcggggtggatctcgccgacccaacccagcacggtgccgccggacagaacctcggccgcacgacccggctgcaaaaaggcatagccctcgccctcgacgggacggaagcgaaccttctcgatgcgcagctgggcgagcagctcctcgacgatacccttgccaaagaagaaacgcagtttacggtacttcatgttccaagactgctcgctccactggcccgaaagcacgcccgcgacggacttggtctccttgggcaggctggcgttttcgcggccatggaacaggctgccgacctcgtacaggtgcacgttgggcgtaccgtgcgcctcgttgtaggccacggattgcagcaggcccggcagcagcgagcggcgcatctcggtctgctcggccaccagcgggttcatgagcaccacggggcagccgcgaccctcggcgggcatgccgatcttctccaggtcgcccggggcggcaaagccaaaggtcgtggtctcgttgaggccgcaggcgcgcaggatctcgccgaccttgcgggtaagcttctgctcgcgcgtcaggccgccgatgtggttcttggcagccggaatggtcgccgtgacgcgacccatgccccacaggcgcaggacctcctcgatcaggtcgatctcacgcggcaggtcgggacggaagctcggcggcgtgaccataaagtcctcgccgtcgcgctcgacggtgcagcccaggcgggtgagcgagcgctcgataaagtcgggctcgatgtcggcaccgcagatggcgtgcacacgggccaggcgcagcttaatgctgtcgatggtcttgggcgcggggaaaacgtcgacatagccgggagcaacctcgccgccggcgatctcttcgatgagcgcgcaggtaacgttggcgacatccacgcagccggtctcgtcaacctggcgctcaaagcgaatggaggcgtcggagatcagcgacaggtcacggctggtgtgcgaggtgcggccggcgttgaagcaggcgctctcgaccatcacgtcgacggtatcgtcctcaatctcggaatccatgccacccataacgccggccagcgccacgggacgctcgccgtcggtgataaggcccatgccggcgtcgagcacgcgctcctcgccatcgagggtcgtgaacttctcgtcctgctgggcggcannnnnnnnnncctgctgaaccgctcttccgatctgtatggtctcgtcctgctgggcggcacgaaccaccacgcgacggtggccatcgcgctcggcaaaggtagacaggtcaaaggcgtgcagcggctgaccggtgagcatcatcacatagttggtgatgtcgacgatattgttgtgcgggcgcacgcccagggcgttaaggcgcttgaccatccagtcgggcgaggggccgaccttcacgttacgtacgatgcgggcgacgtagcggtcgcacaggccctcgtcggcaatctcgacggaaagctcgtcgtcggtcgcgcggccggtctcggccttgatggcgggcagctcaacgtggaaatcgcggtcgaagatggcgccggtctcgcgggccatgccgatcatggacaggcagtcggggcggttgggcgtgatctcgcagtcgagcacagtgtcgctcgaacccacgtactcggcaaacggcatgccgcagggcgtatcctcgggcaggatcataatgccggagtggtcgccgcccaggccgagctcgcgtgcggagcagttcatgcccatggacacgacgccgcggagcttgctcttcttgattttgacgtcgccgggaagcacggcgccgatcatggccgtgacgatgtggtcgccagcctcgaagttctgcgcgccacagacgatctgcagcggagcggggttgccgtcggcgtcgagattcttgtcacccacgtcgaccgagcacacatacatatggtcgctatcggggtgcggggtcttggtgagcaccttggcagtcaccacgtggtcgaaggactcgcccacggtgtcgatcgcctcgacctcggtgccggtacggatatagacccggccgaactgtccgaattcgcccgtcggccgttgccccttagcgcgaacaacacaacgcccaccattgtcgcacgccttccccacctagtcatagaagagacaaggagtgtccccagctgccggcagagacgatatgagcaggacataaaaacattgagagcccctgctgcatgaaagaccgcggattaggccgacaatggtgagtgtctaattcagccgcggcggccacgccgcattcatggaaggggctcccatgctcgatactaccaccttcgtcggcctcgacgtccacgcccgctcgataaaggcagtctccctcgacgtcatgaccggggaggtgcgctgcgcgaccttcggctacgacgccggggcagtcgcggagtgggtgcggtccgtggacccaaaggccaagtgcgtgtacgaatccggggtcacggggttcgacctgcagaagaggctctccggcctcggggtcgactgcgcggtcggcgccgtctcgaagatgatcaagcccagcgcggacaggcgcaggaagaacgaccgcaacgacgccgagttcctcgcccgcatgctgtcggtcggcaacgtggtcgaggtgtgggtccccgacgacgagtgcgaggccgcccgcgacctgaccagggcgctcgaggacgcgagggacgacctctcgcgctcgaagcagcggctctccaagttcctgctcaggcacgggctcgccttcgacgagaggacgcccaccggccgcaggaagggcaactggacccgggcgcactggtcctggatcgagtcgattaggttcgcggagggggccgacgaggaggtgctcgcctactacgtcgacgcggtcaggcgggcggcggaggagaaggcgaggctcgaggggctcgtcggggccgaggcccgcaagcccaggtggaggaggagggtcgactccctgcgctgcctcaagggcgtcgacaccgcgtccgccgccgacctcgtgttcgaggccggcgagttctcgaggttcaggaacgcccggtcgttcgccgcatgggtcggcctgacgccctccgagcactccagcggggagagcgaccgcaggggcgcgatcaccaaggcgggcaacaagcacctgaggaaggcgctggtcgaggccgcgtggcactacctgacgtgctcggggcggccgaagggcctcgccaagggccaggccccggaccgggtcgcccgcaggcatgccgccaagggcgtgcggaggctggtcgagaggcgggaggcgctgctcgcgcgcggggtccacaacaacaaggcgaacgtggccacggcgcgcgagctcgcctgctgggtgtgggcggtcggcctcatggccgaggaggcgtagggggccggtcccccgcacataagccgatcaccccggaagcggttcgatccgaagccgttgaggcgaacctcaggtcccttttctgcgagcgcccagggcgccacacgcgtgcacagactgtcggttcgacgtagaagcctcagccgtagcaacggattgcccagcgagagatcgccgcgggcggatattaaactgcaaagacgagcgtcgggaagacacgccgaggtcgccgcggacgggttgatatagggagagggcctgaccccatatcgttggggccaggcccgattttgcctcttgacaatgtcctgctcatattaaaaaagggggaggccgcgaggcctcccccttcttcgattcaagcgtacggctcggtgccgtccaccggtcagcggcgccctggcctcccacgggctgaccccgcagtactctcggcgcgatggggcttagcttccgggttcggaacgggaccgggcgtgccccccatgctctggccgctgaccggtgggcggcgcccaccgttacggtgtccggtgtctgtctcacgtgccctgggggccgcatggcgcataggagagtgtgactcgggggcatcctcgtgcccggaccgcgcgtgagcgctgggtcccgcgggccgcgaggtgcggttccggaagagctcgggcgattagtgcggctcggctgaggctgtcgccagccttgcacctgccgtctatcgaccaggtagtctacctgggcccttaccggaaggagaactaatccctggaacggcttcccgcttagatgccttcagcggttatccgcgccgcacgcggctacccggccgtgccgttggtcgacaaccggttcaccggaggtgcgtccaccccggtcctctcgtactgggggcagcctccatcgattctcctgcgcccacggaggatagggaccgaactgtctcacgacgttctgaacccagctcgcgtaccgctttaaacggcgaacagccgtacccttgggacctgctccagccccaggatgcgatgagccgacatcgaggtgccaaaccttgccgtcgatgtggactcttgggcaagatcagcctgttatccccggagtaccttttatccgttgagcgacggcccacccactcggggccgccggatcactagagcctgctttcgcacctgctcggcttgtgggcctcgcagtcaagcccgcttgtactcttgcattcaaaaggacggttgccgaccgtcccgagcggaccttcgcgcgcctccgttaccctttaggaggcgaccgccccagtcaaactgcccgcctggcacggtccccgagccggttgacggcctcgggttaggacgccggtcgcgcgagggcagtattccaagggcggctccccgggggctggcgcctccggatcttagcctcctgcctatcctctacacgcgggaccagcggccaatgccaagctgcagtgaaggttcacggggtctttccgtccttccgcgggtaagtcgcatcttcacgaccagtgcaatttcaccgggtccatggtcgagacagcgcccaagtcgttgcgcctttcgtgcaggtcggaacttacccgacaaggaatttcgctaccttaggaccgttatagttacggccgccgtttaccggggcttggcttcggggcttcgccttgcggctaactcctccgcgtgaccttccggcaccgggcaggcgtcagaccctatacgtcgccttgcggcttctgcagagtcctgtgtttttggtaaacagtcgcttgggcctctccactgcggcccgcctccgctccccgggcaagccggttcacgtacgcgcgggcaccccttctcccgaagttacggggccattgtgccgagttccttgaccatggttgacccgatcgcctcggtatgttctacccacccacctgtgtcggtttgcggtacgggcgcgcacgcgcctgcctaggggtttttctagggacctcgggctcactcgcttcgcttgatcgcttcgtccggagcctcgccctcgtgcggaccggatttccctggtccgcgggccgcgctccatcacggggacgtccagaaccccgccgagccacccccatccgtcgccccgtcggtcgtagcgccgcgtgcgcggtgcaggaatgtctgcctgctgcgcgtcggctacgccttccggcctcgccttagcccccgactgaccctgggaggattagccttgcccaggaaacctcgggttcacggcggacgagttactctctcgtctctcgctactcatgccagcattctcactcccatgcgctccaccgccggtcgcccggcggcttctccgcccatgggaagctcccctaccgattctacttaggtaaaatcccgccgcttcggtgtccagcttagccccgtgtattgtcggcgcatgtccactcgaccagtgagctgttacgcactctttgaatgcatggctgcttctaagccaacatcctggttgtctgggcggacgcacatcctttgccactcggctggaacttggggaccttagcgggcggtccgggctgtttccctctcgagcacacagcttagcccacatgctctgactgccgcgctctgggccgccggcattcggagttcggttggattcggtaggcggcgaagccccctcgtccatccggtgctctacctccggcggtgaacgcgcgacgctagccctaaagctatttcggggagaacgagatatctccgggtttgattggcctttcacccctatccgcaggtcatcgccgccgttttcaaccgacgtgcgttcggccctccacggggtcttacccccgcttcagcctgcccacggatagctcacccggcttcgcgtccgcggcgcgggactcaagtcgccctgttaaggctcgctttcgctccggctccctttcggttaacctcgccccgcgccagcgactcgctggctcattctacaaaaggcacgccgtcacaccacatgggtgctccgactgctcgtgggcgcacggtttcaggtactgtttcactcccctcccggggtgcttttcacctttccctcacggtactggtgcgctatcggtcacagggtagtactcaggcttggatggtggtccacccaggttcggaccgggtttcacgtgcccggccctactcagggaccgcgtcgcgccgtccggtctgggttcgcgtacggggctgtcacccgctgcggccggccctcccatgccgttccgctccccagccggacctgcgcccgggggcggcagcccccggatgcgcggccctgcaaccccgtcggcggaacccctgccgggtacgcccgctcgacggtttggccatcggtcccctttcgctcgccgctactcggggagtctcgagattgatttcctctcctccgggtacttagatgtttcagttccccgggttgtcctccccccgcctatgcgttcagcggggggatatgcacactgctgtgcatgggttcgcccattcggagacccccgggtcgaaggatgtgtgctcctcgccggggattatcgcagcttgccgcgtccttcatcggctccctgtgccaaggcatccgccgtgcgcccgtggtatcttgcgggaccgcatcgggcccgcgggatatccacgtgtcgctaattaatctaattaatcgatatcatgaatagcgctcgtatgtcgcaattcgggtatctcataccgcggcacagtcttgactgtgctcgcgatcagatgctcctcactcatgtataagtgaattcttcttgtttggatcggatgaatgattgctatcattcttacgtttaatcgcagaaaagaatcgagtctggaagaaacaagtcttccatctctctcctatcgctatgcggctctcaaggtacgcgggtgcgaccccggggaccgggtgctgcggggacttcatcgcgggcgacatccaccggacgggctcctgccctcattcgagttaaagtgtttctctctaagaactaatctccctagaaaggaggtgatccagccgcaccttccggtacggctaccttgttacgacttcacccccctcaccctccacaccttcggcgcctccccccattgctggttgggccggcgacttcgggtgcagacgactcgggtggtgtgacgggcggtgtgtacaaggcccgggaacgcattcaccgcggcatgctgatccgcgattactagcaactccgacttcatgggggcgggttgcagcccccaatccgaactggggccggctttccgggatccgctccccctcgcggggtggcatccctctgtaccggccattgtagcacgtgtgcagcccagggcataaggggcatgatgacttgacgtcgtccccgccctcctccgccttgacggcggcggtcccgcgtgggttcccggcatcacccgatggcaacacgcggcgggggttgcgctcgttgcgggacttaacccaacatctcacgacacgagctgacgacagccatgcaccacctgtatgggctcctctcggccacggggtctcccccgcttcacccatatgtcaagccctggtaaggttcttcgcgttgcttcgaattaagccacatgctccgctgcttgtgcgggcccccgtcaattcctttgagttttagccttgcggccgtactcccataacgcctttgatggtggggaagtggatatgacaaaagacgataggcaggcattcgaggtgcccgatcgactctttgaatacgtgaggtcggtcgtcgacaaccgcgcgcttgcaacggtgctgctctttttgctgagcctgctgctgattggcatcgataacatcgctggaatcttggcggtgctgcttgtcggctttttgctgatcgatcgatttgaaatcgtacgccgctgcgtggtgattggcggtgccgcgtgggccatgacgttggcgattggcgccatggcactcggcggcatcgaagggccggtgctgttcgatgccggctttgtattcaacatgcttggctttgtgctagcgcttgccgtgtgcgtgctgttcttttgcggccgcgccctgtactaccagggctatgagcagggcgagcagcatgccgattgtgtgctggccgctcgtattcaagatcgcctgatcgatcaccccgacacctgggacaacatcgacggcgacttcctggaggtcgagggcgcactcaaccgtgtgcgcgatcgcgagcgcaaggtgcaacaggccttgcgtgacgagtctcatcgcaaggacgatctggtcacgtacttggcacatgacctacgcaccccgcttgccagtgtggtgggctatctttcgctgcttcaagaggctcctgagctgccggttgagcaacgtgcgcactttacgggcgtggcgctcgacaaggcgcaccggctcgatgcgctcatcgaagagttcttcgatatcacgcgctttgacttccacgatatcgtgctcacgcgcggctatgttgatctggggttgctgctggctcaggtggctgacgagttctatcccatcctcaacgagcagcataaggaagcccaggttgatattcgcgaggacctgacggtgctcgtggatggcgacaagatggcccgcgtgttcaacaacatcatgaaaaacgccgtcgcctatagctatgagggctcgactatcacgattgaggccaggcgccaagacgatggcggtgtgcgcgtgcgctttatcaatcagggcgatcctatccctgcggctaagctcaaggtgatctttgagaagttctatcgcctggatgcggcgcgtgcgaccaatcgcggtggtgccggcctgggccttgctattgccaaggagatcatcgcggcacacggcggtaccgttgcatgtgaatcgacgcccgaacacacgatattcaccatcgagctgcccgccgcatagccagtgtgcccttacaaacacttgacaatgtgctcacgtgcgtatgagccgcgattcctactatcgatactgctgaattgatatcgatatggaggtgtgcggtatgacggctgctgcggctgtggagcccacggagcttgaagaactcatggaagcgcaggccgaggccgcgcatgagcgcgaggttggggatgcgactcgccccacggcagaggatcttgccgcctcgccgacgcgcatcgacgtcgagggcctcgacctgttctatggcgatcaccatgcgctcaaggacgtgaatatcaagatccgcgacaagcagatcacttcgttcatcgggccttcgggctgcggaaagtccacgttgctgcgctgctttaaccgcatgaacgacggcatcaaggattgccgcatcgagggcaagattgcgctcgatggtcaagatatcctgggcgattgcgacatctgccgtttgcgccagcgcgtgggcatggtgttccaacgccccaacccatttcccatgagcatctacgacaacgtcgcctacggtcctcgcggtatgggtgtgcgcgaccgcgccgtgcttgatgagctggtcgaggactccctgcgtcgcgctgccctgtgggacgaggtcaaggacaagctcaaagagtcaggcctgggtctttcgggtggacagcagcagcgcctgtgcatcgcccgcgcacttgccgtgcagcccgacattctgctgatggacgagccgacctcggcactcgaccctgtgtcgacgttggtggtggagcagctggcctgcgagctcaaggagacctgcacgctggtggtcgtgacgcacaacatgcagcaggccgcgcgtatttccgattcggttgcgttctttttgctgggtgagctggtggagcacgcgcccaccgcgcaactcttcaagaatccgtccgatccgcgcaccgcggattatttgacggggcgttttggctgacgctgtcttttacaggtgcctttagggttaagatgcggtcatatcggccgcaaaggggttcaacatgatctattacgtcgaggacgatgacaacatcagggatttgacagtctacgcgctgcgcaagcagggaatcgaggccgagggcttttcgtgtgatggcgagtttaaagctgccgtggcacgacgggtgcccgatgctgtgctgctcgatatcatgctgcccgacaccgatggcttggcgattatgcgtcgcctgcgtgccgatcgcctgacggcgacggtgcccatcatgatgcttaccgccaaggacaccgaactcgacaaggtgatggcgctcgatggcggtgccgacgattacctgactaagccgttttcgctcatggagcttgcgagccgctgccgcgcactgctgcgtcgcggcggcatggtcaagcaggcgagcgatgtgctcagcgtgggcgacatcgtgctctcgcccagccatcgcgaggtgaccgttgccggcgagccgcttaagctcaccctgcgcgagttcgacctgctcgagtacctcatgcgcaagcccggcgtggtctttacccgcgagtcgttgctgcagagcgtgtggggctgggacttcgacggcggttcgcgcaccgtcgacgtgcatgtgcagacgcttcgccaaaaactgggcgagcatgccagcgccatcgagaccgtgcgcggcgtgggttaccgcttggccgagccttctgccggtgatggtgccgaaggcgacgacaccgcggccaccgcatcggaggagtaacccgtggtcttcgccccccagggaaaacatacgctgtcgcaccgcgtttttgtgacgatctttgtctgcgccatggcggttatcgtggcgtttacggtgctgggcgcgttctttgtgcaaaacactttggcggatgccacgagtgccaatctggcgcaggaaactgagctcattgctgccgccctcgacgagcagcaggagcccattccgttcttgcgaagcctcgatcgcgaggatcttcgtatcacgctgatcaataaggacggatctgttgcctacgacaacgaggcgtcgccttccacactgcccaaccatggcgatcgccccgaggtcatcgaggcctttgagagtggttcgggttccgcggagcgcgcaagctctacactcgnnnnnnnnnntcgacgagattatgctgtatcgcgctgtcacccttgataacggccaggtcgttcgcttggcgcaggcccagcctggcgttgcggcgattttgctgtcgatgctggcgccgatgctgcttatcgcagcagcgggtgcagtactctcgttttttatggcgcgccgtgagtcccgtgccatcatcgcgccgttgcaagaggtggatttggatcacccacgccgtagctatgagcacgcctatgccgagatggtccccatgcttgagcgtatcgagtcgcagcgccaggaactcaagcgccaaatggcggtgctagcggataacgaccgtatgcgccgcgagttcacggcgaatatcacccatgagctcaagacgccgcttacggcgatttcgggctatgccgagctcatcgcaaatggcatggtcgagggcgaggacgacctgcgcaannnnnnnnnnntggcggtcgcatctatcgtgaggcgggccgcttgtcagcgcttgtcaacgacatccttacgctgtctaacttggacgaggccgaacgtgcaactgaaggcgaggcagtgcccattgggtccacggagcctattgagctctcgcgtgcgatctacgcggttgagcagcgccttgaacaggttgcccgtcaggcgaatgtgacgataagtcatgagaccaagcctgtggtcatcgaaggcgtgtcgcgcctgattgacgagctcatctataatctggcaagcaacgccatccgctacaatcggcccggcggtacggttacgctgcagtgcggcaccaacgacgaaggctatccgttcctcgctgtcgccgacacgggaatcggtatcgcgcctgaagaacagggcaaggnnnnnnnnnnnnnnnnnnnnnnnnnnnnnnnnnnnnnnnnnnnnnnnnctatcgaatcagcccatcgggcgcactggcatcataattgatgtgtaccgtatcatcacgccgcgctcgatctgtcgagtgagttgggcgtgggaaccaccattacggtgacgtttcccatacagcaggacgagccattcgcatagcgatacaacatagatattgatgtagacgccgcatttgactttcgggtgcggcgttgttgtgcaattttacgattgcttccgacatttttacagaagagcctgtttcttatgtatagagtttggtctcggtaaaaagatgcgataacatacggacagttttgtcaatccgaactggggaaatgaaaggcaagctgcatgacccttctcgaactgttccagctgctcaaaaagcaccttaagctggtcatcacccttccggtggtctgcgcgatcgccatgggcatcgtgtccttcgttgcgatggacaacacctatactgcgacgacgagcatgtacattctcgccaagaccgacgataacggtcagatgagctacaacgatctctcggcgagccagatgctttccaacgatatcgccacgctgctggatagcgatagcgttaagagcggcgccgcctgacccaggccagtcgcgcccaagtggacgaagtactgcacgtgccgcgttaagagcggcgccgccaatgaactgggcctcaccgatctggatgactacaaggtgtctgtttcctccgagaccaccacgcgtgtcattacgctttcggttaccggcaccgatgccaaggagacggctgaggtcgcaaaggccattgccagctcggcgagtacggtcgctcagaacgtcggcgctgcccagagcatcaacgttatcgacgaggctaagacccccgaagcccccagtggccccaagcgcacgctgtatannnnnnnnnnnnnnctatgtcgttttggcagacatgctcaatacccgcatccgcggtgccgaagaggcagaagagctcctgggtattcccgttgttggccgaattccggctatgaaaggtggtaaataggcatggctaaggcaaagaacaccgataagctcgttgtacagaatgccgccaagacccttctggccaacatccgctttgcgagcgtggacgaccccattcgtaccatcaccgttacctcctcgattcccaacgagggcaagtctacggtttccattaaccttgctcaggcaatcgccacgagcggcaagtccgtgctcctggtcgaggccgatatgcgccgcaggtccctttccgatatgctcggcgttcgttcgcgcggcggactctatgcggtcctttccgagcagatttccattgaccaggcaattgtcgagacgggtcagaagaacttctacttcctcgatgccgagccacacattcccaatcctgccgacatcatcgtctcccatcgcttttccaagttggtcaaggcactgtctgctaagttccagtacgtcatcttcgatgctcctccggtcggcaccttcatcgatgctgccgagattgccagcctgaccgacggcacgctgttcgtggtgcgcgaggactttaccaagcgcgaggaggcgctcaacgctatcgcccagcttaagaagtccgagaaggtcaagctcatcggtagtggtggtggtttgagaactcaagagcgtgtttgtactacttctttatagtcaatgattgccagttcattcctcgcctgattgcctgtcgtggtggttgggtacccgggagggtttgatgaggggtgaggttttttgagggcgtccttccttaaggacgtgctcttcaatttttgttttgagagtcatctattcggatgcttttcatgaggtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaatgcagtcggatgttcgtccgacggtgtgcgccccgcgcgtcgcatggtgcgatggcggcggggttgctggtgtggaagacgtcgttggctttgccctgccggtcgtgcggtgggtgcggggtggtatggatgcgcttttgggctcccggatcgccaccccaggctttttgcctggcgcgattcgatgcccgtcgtgcctgggggccggccgtgtgccggcgcgatggcgtggcggtgcgtggtggcttgagaactggatagtggacgcgagcaaaacaagggtttttgaatctttgttttgctgttgatttcgaatcgaactctattgttcgtttcgatcgttttgtgatcatttttagtgtgatgatttgtcgtctgggaatttgctagaggaatcttgcggccatgcactttcgtggtgtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttttagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcgaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagatcgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacactaacattccaacccctggcggttggaccgcatcttcctcctgcaaacggcaccagacggcaatgagcattgtctggccacaagacgaaacatcgacatatccgcgtccgctgtccggttcccaggccgccacaggccggcagaccccagcgtctgaccgtacaagagaagatttgcggcggccatggcccaggtgagacgcccggtcccattccgaacccggaagctaaggcctggcacggcgatggtactgcacccgacagggtgtgggagagtagcacgccgccgcaccacacgtacaggaagcccctttcgtttcacgctagatggcgaatcacttcgaagcccagacaggcacccggcgagcaagaagggagaagcacgatgcacaacgtcaggacaaacgcaagcatgacttcgctgttcttcgcgaacgtcctctactgggtctgcgcgggcgtgtactcgccgttcctctccgctcactacacgagcctcggcctcagcgcagctcagaccggcatcctcctcgcggcgaccccggtgtgtgcgctcgccatccagccgctctggtcgacgatcgccgacaagctcgggcgccgccgcgcagtcatcgtgatcctctgccttgcggcggcggtactcgctccgctgtattacctggcgtcgacgttcgtcccggtccttctcgtaacctttgcgttctcggcgtttttctcggggcttctgcccctgagcgactccctcgtcatcgagctcgcggatcgctctggcctggacttttctcgcattcgcatgggtggtactatcggctatgccatcgtcgtcctgatcgtcggtcggctgctcgacatggctcctcaaatccagttcgcggtggtctctgccgcgctggtggtcttcgcggctcacgtgtggcgcctccccgaggcgggaattcgcgccaatgccgcggacgatcccaaggtctcccacggaaagggcctcctctcgctcatatgacccaatccgctgtcaagagccacaatggccccgccgaccgcttgcaatcggtcggcggggcctgccgttgaacccgtcccggtccgcccccggcatgtcgtcgacgccttcggctcagtctcatatccgcggataccgctctggcggcccgcaatcctctccttcggcgggggttccccaagtctgtcgacgcgaatgcggcgaccgccgcgcgcacagcgagaacgggggtatccccgaaggctgcccggctcgccgggacgggggctatgtctattcgccggcctcccggcacatcatgccgagggcccacagccacctcacgagctcggcggcggtggcggcgttcgccttcgcctggggcatgcccctctcgagcatctcctcgcgtcgccggagcaggcgctcggaccccttcctcccgtgcatccttatctcgagcgggactccggagcccttgggcatcagcttgggctggtgcccggcctgggcgtagcgccaggacccctcgaccgccagcctcctgacgagcgcgttgccggccccgctgattccgccgagtcgcacggagtcggcgctcgacctctgcttcggggcgaggccgaagtaggccgtcacctgcctgccggagcggaacctcgagaagtcgccgacctcggacgcgaaggcggcggcgagcacgaacccgcaccccttgatggactggagcgcctcgacctcggccgagagggggcccgccgcgacagcggccctgtactcggcgaggagggcctccctcgtctcgtcggccgcctcgacctcgttcctcagcgccgccagcgcccggatgccgccgtcgtcggcgggccgcaccttgtcgagccacctgaggaagccgtacgtccagtacttccgggggtttcccgccggcgtcgtgccgccgtagacgtagccccggcgggcgaggaacgccaggagccgctgcttcgccgccgcgagcctggcagtcgcggcgtcgtaggcggcggcgaggtccctgagcccctcgatctcgggggacggcacccataccggggtgacgtcgtgcgacagtatcgccttggccatcctggccgcgtcgttgcggtcgttcttggacgagaggtcggccgccgacctcgggaccttggagacggccgcgacgacgcagtcgacgccgagggccgacagctccctctgcggcgcgaagccgaggtagccgctctcgtaggcggcgagcgacgggcccgggaagcccgacatccactccgcgacctcgccccacgggttgccgcggaacctcctcgccacggcctcgcccgtctccgcgtcgagcgcgcagacggtggtggacctgaggtgtacgtccattccgaaggcggtagaatatctaggcacgggagcctcccaacctcgttgcggcgcggctgcgcctctggcacttcaacaacattgtcgcagccccgacccgcggtcacgagcgggggctcctgtcgtttccgtgccctcggattgggtcatagtgtctgtcggtgccaagacatcggcgttgccttagctggtgcttggatcccttggggacggaggaaaatgtaccatccagaatgagcgtggataatctcccggttttggcctgtgtgggggctcaaagtgggagattgtccacgctcatttgataagtgtccgaaaatccacgcttgttgctacttgagtcctggcaggcgggtgtaggggaatgagcgctctaggaactcggcgcagcgggcgtagtctttggcgaagtagctgctgtagagcgaatcgagcacgtattgcacggcgatgtggctggcgaactgcgtgatgcggtgcgtcatgctctcgtggtcgctcaccgtgagataggcggcaaagccagggtggnnnnnnnnnnnnnnnnnnnnnnnnnnnnnnnnnnnnnnnnnnnnnnnnnnnnnnnnnnnnnnnnnnnnnnnnnnnnnnnnnnnngctgctgaggatcggcaagatttccttgaggttgggcgcgaggccgctgtaggagatgacgatggccgcatggccggaatccgaggcgagcgccgtgcgcacctgggcctcgatgctgccgtagcacgtggcgcttttgccggacgaaagcaggcggtcgcggaacatccccgctggatagaggttgtgcgagcctgtatagatgtcgacctgccgtgccttcgcgatcagtttggcggcgtggtcgagctgcgcggggtcgagcatttcctgtgtctcggccagtgtggtctggtagagaccctccatgcgttccataacctgtgcaggcgtggatgtggcatcgaagggaaagttgatgtccacgtcgcggcggttgcccgcttcggtcgccaggcggataagctcgaccttgaggtccttgaagccctccaggccgagctttttgcagaagcggtgcacgctcgcgaccgaaacgttggtgcgcgcggcgaactccttaatggagagcccgcggatgtcctcgcccatggcaagggccgagataccgagctgctgctcggtgggggtaaggccctgcgcctcggaaatcttgcgtttgatatccattcgaactcccacactcgccaaacctgccaaaaagggacagggttattttggcaggttttgcccgcaaagggtaacggggccgaggacgccgctgggcgcgatgggctcggtgaggacaaagatgtcgggaatcgcatggtcgagcgtgttgatgacgtcgatggtgagctcatgcgtgccagcggcaagcgggccggcggcaaagcgatagggcgggcagatgcgcgtgccgagcgtttgcccgtcgagcgtgagcgtcgcgacttcgtagacatcccccaggtcaatggcggtgtcggcgaggtcgcaggccagctcgaacgaggtgcggtagcggtatgtgccgcaggtgccggcgaactgctcggccgtgaggtcgcacaggtgctcgagcttttgcggctcgccaaaggccccgtcgcctccggcgggggagagggcgacggtccaggggctgtcgatatcgaggacggacgcaccatccgcgctgctatcggactcgacttcgccgtttgcccccagaacaacaatgcagctctcgaagggctccagctccaacacgccgtcaaacgcgacaggggcagcatcgtttagcaggtcgaggcgcgtgccgcaaaggcgttcgcctgacggaagcgaaacggcgcaggcaatgctctcacgtggatgctcgttgacttgcatcacataggtctcgcccgcgcgctcgtagcgcagtgcgcgcagccagggctgcggcgtatcggtcacaacggtctgcagtcccgcggctgccagcacgtccgccacgccggcaagtggtgtcgccgtaagcccgtccagctcggccgcgccatccgcgtcatagaccgcgccgggcacctcgtcgacggcaagcaccgtgacgcccgcagccatcatgcgcctcgccgcctccgtcgtagcagtgccaataaacgaggctccgggcagaacaaacgcctgataacggcagccgttgacggcaaacgttccatcggcgatcgaaacctcgtaacgcccctcatcctcaaaagcctcggttggcacaaaatcaaagtcgatttgcgcgcgcgtgagctcggccgccacgcgctcgacgggcatggcgttgccggcccattcggcatcggcatggtacagaacggcgacggggcgggtggcagcgcctcctgaaagcaacgaggcagtgcgattcatatagctcatgagctggccaaagtgcggccattgcgggttgttgccatgcgcgtaaaagtgcggcgggcagtcccaatcggggaagggcgccatgctaaacgcgtgcggcgtaaacgccgcggacgagcatgtggtcggcgatccacttcatctcgcgcaagccctcgtgccagccaaaggcgccaaagacctcggccatacagcgcccctgctttttggggtcgaggcgcgcggctgaagagcccagcttggcaagcgcgtacgtaaagaactccatgttccacgcgccgtggaaatagctgtagtgcccacggtcaattccgggggcaagctggttgatgaccacatccacgccggccatgtcctgtccggcgacggcgcggaagtagtgcccggcgccttgacccagacgcgtgtggcaacccttgtcctcgatcacatgtccaatgtgcataacgccgtgcgtgcggcaccaatcgccgatctgctcgtcaaagcagctgcggtagagctgggtggcaatgtccatgtagacgtgtcgagcgcgggcgccgtccgcctcgcgcgtccaaaggccgtgcagttgggcaagccaatccnnnnnnnnnntcgccgagcgcatcgcgcaggcgacgggcaagctcgtccgaccacggcagcgccaggtcgcctcgcccgataaagctgctggtagaagcatcgtcgagtgtggtgcccttctcgttcataaagccgggctcgtcggtgaaaaagcccaggatggtcttgccgaactcgtcgcccaggtgctcaagcgtgcgctcatagacagcgtcgatgagaatgcggcacgaggccatatcgaccatgttgatgtactcatcgcgaaagccggtcttttggctggtgacgtacagctcgatcgtggtgacgccggcgggggcgttaaaacgcagacgggtaggggcgccgtcgtcggcctgctcaacggcgatcccaaggtgcagcggcgcacgtgaaacgccgccacaggccccgcaggaacccccgaagcccatcaggacgaaaaaggcgctcaccgacaggttcaagacacggcttgacgagcggctggccgaaaacgaacgcaaacaggccgaaaaacaggccgaacccgacatggaggagacatgggacctctccgaccccgccgacccgctcaacatcggcatgggctggggcacgggaggccacggactcggcctgtgagaacgccgggaacgcaaagggccggcatccgaagacaccggcccgaaatttagaaagacatccttaccagcgggtaacggatacgccgtcgacgccagagccgtctgccgtggcgatgcgcatccacggaccagctgcgacaggggtgtatgtaactccattgattgcgaaggtgatctgtcccgacttattgccggtcgtatagctgttgcgatacggccaggaccccgttgccgttccggtgcctgcaaactgcatgtcacccaaagaggtcccgccagcccagcatccagcattggaatcagcgcatccacgcgagacagttaccgaataatcttcagcctcgctcggcggcagcacgtccaccaattcgccgttgctggaatcaaagagaatcgttgtgccaggttcgccgacaatcatgtccccgcccgacggagtggtggtaagttcatagaacgactcgtcagtggtttcttgagcagatgccaccgggactgccgtcgacaggagcgccagcagagtcattggaaccactgccatcttcaaatgcttggtacgtaacatttttgccccccttgattaggtatgccagacgtgcgtctgacaaggaaattatagctcttggaccttggattgaacagaccagtaatgcaaagggttggtgtttgaagacgccggccccgcatccgaagacgcggggccacggcccaatcaaaggggatggcgggtaacccatcccgccggcatcggccatccccgaaaagtcatgcatgcccgcctgatcgtaagggggaagttagcagcgcctccgccggcgtttccatcttagccgatacgattggcgtcgtcgatggacgtcttgtagcagggacgaaaaccgaccgcccggcatccgccgggcgacgctgccgcgccagtcgcggcgcggcccgaacgaaaggcgcagcacatgcgcatgggtaacaaggggccgcacggccggccctggatatggctgatggcggtcatcgtcatctgcctcgctcccgcgatggatcccatcgcggccgacatcaccgtgacggccctggccgtctgggcgatggcatccagccgccgttgacggcgcaacctgccgcgggtcggagcccgcggcaggccccttgttcagaaaagagtcggctcgataccaggctccatccgatcatcgggcatggcctgtgaatcatggctgcgtctggccacctcgaatggtgtcagaccatcgtgggccgccttatacgcatccagttcagccctggctcgttccgccgcaagttcacgctctgtacgttcttccgcggcctttctgcgctcctggacacgttcctctgcctgcactgcacgttccgcatcttttatctgcgcgtccactgtgcgagcagacgcatgttccgcgatgcacgtctgtgccacagtcggcactgaggtctgtgacggccataacgtcacatactcacgcccgcaggtaatacgagccgccggatacacctccagcacctcagcgacggcctgtttgaagtttctgcgaaactggttcatggccgaatcgctgccgaactggtcatatagtttctgccacttgatactcacacggtcgtgcatgttgtagtagcgcttggtcagccaccaatacacatccaatgccatcgggcttttgatcttggccaccgtgggtaggtcgaccggcacaggactgtcttgaagcatgcgcacgtactctttggacagtgtcacccaattatcggctttctccccacgcttgagtggcttcgtttcgttcagccagtcgatgtgcacgcggggagccaccacgaacgccgccatgtccgtctgattcgggtcggtcagattgagaatctgatacgtgcagcggaacagtcgttcgaattgcgacttgataaccttgagctgacgaccaccgacattgacgttcaacagtctaagaaagtcacggaacgacgaaccgaggttcaacgtgcgcgtttcgggattccagcagtcatcaccggttttgatcatcgtgcacgcccacagttcgaacaaacgagggtacttgccgtacggcaaacagtccgcgccacaaatgaaatgcacctcaagcgaaccattgcgcttgacgatctcgtgcatctcctggcgccgatacggcaaagatacctgagctgcgatcttggagatgaacgcatgtgacatccaagggtcatcactgggtacaactagctctttagaatcagtcatgtaatcacgactcactttcgtggtttccaagctcctggagattgccgtctcgcgggagcatttcctatctgtgtactttggacacatgttagcatggtgtgtccaaagtacacagattttgtgtttaaagtacacagattttgtgtgtactttggacacagatgaggggctttaaacacaaaatgaggggctttaaacacaaaatgaggggctttaaacacacgcacaccctctcagcccttgtgggagtagggctgagagggtgtgccagatagacagatatacagatacttagaaaatcgaattcaaaaaagtgtgtccaaagtacacagattttgtgtttaaagtacactttccgtcatctccttgaattccccttttgggttcttttttagctgcttagcccttgcggcagtagggctgagcggaacctgaaacagttataaaaggatttatgaaaagggcctgcggcctaaggatcgggaaaatcattggtcggagtcgccgctgaagcgcgactgtgccggcctgtaatgctggttcagggcctgaccgagctcgtcgatgtgagcgagctcgtttttattcctcaaaagcgtcctttattctcccaaaacctcccctaaataattcccaaaacctcccctaaataattcccaaaatctcccctttaatctcccattttctcccctttaatagtgcgtttcccctactgccgtaaggcctgcggggagtctaaaagagtacaaaagattctataaaaaggggctccgccccgatgaagagaagaaaccgactcagttccaaggctgctgctgccattgctgtggctgttggaatccgggctggtagccatagcccggctgctcctgtatctgaggctcttggggcaggtcacgaacctgttcccgcagctcacccgccgactcagcgctggggagcctcacgcccgcgtcagaggcccatgcgcgcagttcggcggcatgggccttgagcatgtccagcagcctttgccggttgccctcgtcgttccagacgccctcgtcgtagccaagcacgccctcgttggagaggatgccgcccagccggatgatcagatgggtgcgccgcttgcgcgccttggcgttctccctagccacgatgcgctgtttgcgcgccctgagctgcttcatccggcgctcgatgtcggccatctgctcctcgacgctcctggtcatcggttcctccctgcgttccgtcggttatcaatcaggacgctagaccccacggcagcacggcacggggcacggcgtctacacaccaaacctaaacccggaagaacggagccggtttggacatccaagccgcgagggcgaagcgttcatcaatgccgaacgtgccgcccccgccgatttccgcgcgcatgacggccacgggagggaaacaccgaccggaaaagcctcttcgcaagctgcggcagcttgcgaagagcagccgagaggatcagccttgccgcagtctcaggaaactccccgtaaatcaatcccatgaatcgccaagcccattgcataagagcatcagaaaattcgtccatgcaccgctctatgcgtcgaccgacacgccggtaacggaaccatccccgcaaggtcaggtggaagtccctcaatttcattgagggcgcacttacatgttaccggtggtaacattcagcgtaagcgcgctctcccgaggggccactccgtgggggccaagcgtgcgccgcttggatccgcgccccgtcccggcggggtgccggccacctccccggtggagggccaacgggcctcccggccctttggattcccggaaaggagtacagtcccgtggcgatctactcgttgcacgtgtcgaacgtgagccgtgccgccggctccagcgccgtcgcctcctgctcgtacatcacctcgcgtcggatgcgcgacgagcgcaccggcgaggcgttcaacgggttcggccgcagggagcgcgtcgagcatgtatgcacgatgctgcccgagggcgcgcccggcgagtacctcgacccggagcgtttgttcaacgccgtcgagatggccgagaaacgttccgacgcgaggcccgcgaagaagatcatggtcgccctgccccgcgagttcgacgcccgcgaacgcttccgcgcactggaggacttcatctcatggaacatcacggccaacggctacgcctgcacgtacgccatccacaccgacaaggacggacgtaacccccacgcgcacatcctcgtcgccaaccggcgcatcgacccgaagaccggcagatgggcggcgaagagccgcagcgagttcgcgttggacgccaacggccggcgcatccccgtcatcgaccccgacaccggacggcagaagatcggcgccagaaaccgcaaggtctggaagcgcgtcaacgtgagcaacaaccccttggactccaaggagttcctcgaaaggctcaggcgcgagtgggccgactcctgcaacgccctgctccccggatacgccgtcatcgaccatcggagcttcaaggcgcggggcatcgaacgcatccccaccatccacgagggatacgccagccgcgagatggagaaacgcggcggcaggggcgacctgtgcgaggagaaccggcgcatccaggccctgaaccggctcctcgacgcgcttagggccatgatcgggcggctctccgaccaagcgcaaggcatcctgacggccgtcaaacgccgccaacggccctcaggcgcgccacaggccccttcaagccctgaaccggccgaaaggccacaggaacgcccgcaggctcgtgaaacgccgccacaggccccgcaggaacccccgaagcccatcaggacgaaaatatgttcgactgggtgctagtgggtcttgcgacgtttgattagcatgatgagggctatcactacgagcgttgcgcccgctgcagctgcggtggcgaccatggcgaacgtttggtcgccggtgtttgcgaggttcttcgctgtggtcgtagtcttgaccttggtgtcggtcttagctccgttgtcggacttgggcttgtccgggttcgtcggggtctcaggagtctcggggtcctttgagccttcggaatcggttgggccggcggtgtttaccagcgtatggtccaggaacttcttggcgcccgcacttgcctgtgagaacaggcggcgcgtgcggatcggggtggcgttcaccgttgtgggcgccgtctcctcggcctcgatattcacgagcgtcgtgccggtgtcgaggcccacgtcgttgtatcccacgtggcagtaatactgcgcaccgtcatcgtctgcggtcaggtcaatctcgagttttgaggccgttccagccgcgaggttgccatcggcacccacgagcttaaactctgtctcgccgcggcccttgcggtaccacatataggtcggtgccagccctgtttcgctatcgtcggcaccgagttgcttcacatggccaatcgccgagagcgtcaggtggcttcccgccgtgcgctcaaccgaagagtcgtatccaagatccgacccctccgcagcatccgccgcaggtccgctcacggtcatcgtcatgccatcgggcatggtcttgaccgtgatgattgccgagcgaatacctgtttcggtcgtggatccattcttaacggcggcgatggcgaatcgatactccgtattgggctgcagcccatcccacttgagcgaggtctgcgtgttgtcggcaatcttccagctattgacgaccgcatccgccgcattgctctgcagcatgcccacgccgtagctaaagccactcttgtttgcgagtacatcgtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggtgtccttggtgccgagcttgtcgcccgagtctgcctcgaacttgtcgacatccaccgcgttgacgcccaggcgccacgcaaagccgtacttatccttcgcggcctcgggcaggttgtcgacggtgccgccgtattcggtcgattcactcgaggagttacccgtagtaaagccggcgttggcaccaaagcacaggccgccaaataactcgtgctttgcaagcttcgcgcccatgacaacgctgccgttcagcgtaaagccgtactcaaactcctgctcctcgccctcctcgacttcgatggtctgctcaatactcgctcccgactgcgcgacggcgccgttaaacccatcgtgcgtgtaggcgcgcgtcacgccgggcttgcccagaccaaaggaatcttgcacgggagtcgtgccgttgagcgccgtgtaatagctgtcgggttctcccgaccggttggtcaaaaagtagctgagcggcgtcatgttgtgctgtttggcaatgcggtcataggcctcgacattaacgaccgaggtctgcgcgccgagcgacacgggcgccgccatcacgcccttgccaccagtttcctcattttcgatctcgtactcgtaatagaccatcggaatcgtgtagagcacggccttgtcgccttcgccggcatgcgactcataacttacgctggcgctcactgtgcgctcgctccggtagtcatagcatccctcggcggcaaaatcgactgaagcattaatcgccaccaggggcggacaacgcccaactcggcaccgatggtatagccctgggtttcccccgtgccctttccctctccgtatgacgtaccacccagcaccagatagccgtatgcctgctccaggtcctcaacatagggcgcatcctgcagcacggcaagcacgcgcgggttggtatagaccttatagcggtccttgtacgtgatcttgacgctgtcgttgtcgacatcgggcagcgcgagcgagataaacgtgccgtaggtagtgccgcgacggttgctctcgctaatcacctgctcctcgccgcggcgtacctttccgttctcgtcgagcgaaaaatgcgaggcggtcatccaatagtaatcatcgttcttgcgcaggtcctcgtcgcggtgcttgcccactacggcgataaagctctcgttatagcggtccgaacccgagacgctgcccgccttaacgtcgctgatccacacctgctcgatacccttgtggtcatgcttgttgctactgttgtattgctggccgctcatgctcatggttccgaccatggaacccaagccctgggccccgctctgcgccgtgttgcaggcaaagtcgcggaacacatcgccgcccacgagcacctcgtcgaccgccggctgctcagacagaccgtcaaggttggcagtggcaagggcaataggcgccaaggtgcacggannnnnnnnnnnnnnnnnnnnnnnnnnnnnnnnnnnnnnnnnnnnngcacggatagcgcttatcctgagcactatccttccatgcgctgctgggcacatgcatcagtccataggaggcaaggagcccgtctctgtattccttgcaatcggatagtttgaactcgccagactccgagtcaaaatacgcgtagcggtacagcgcgccgtacagtcccttgctgccgtcataggcgtcgtaatcaaaagcgctgcgttgccagtcatagcccgcaagaataaggcccgtgacggtttcacccgtcttctttccttcttcatcgtaggcggcaaacgtgccgaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgtcgacttggcgatattcttcttgccgtagggtgccgagaccacgatggcgaggtcatcgcaaaaatcccggtcgaggtctccggcagccagcgaaacgacaggagctgactgcagctgcgtccaagagtcgttcccgccctcgttgtgcgtggtgtagtccgcggcgttaccggcgtcgattttgacgacactctgcctccagttgccgccctccaggtcgtacatatcgactacagccttacgcacgccgctctcgtcgacatagcagcccgcatagacaaaaagctcgtccacgccgtcaccatcgacatcgcccgcctcgacatcaaagacggcgtcgtgctcttgcaggtagccggcgttcagatacttaaaacggcctccgtccatcatattggtgttgaccgtcaccggcaggcgcgtatcaaggctgcgcgtgcgcccgttgctaaacgaatagaggaccagctcaacctttccggcgtacgacttgccgtcgatcgtcgtggacgagctgtcaccataggcgcgaagctcggcaacgcggctctttttgcccgtggtggcatcgctgcagaannnnnnnnnnnnnnnncttgtggcgtgaatgcccgagaagccgttgttgtcgttggcgagcactgttgaggactcattgttgctcagatacgaccaggtgccgccgccataatcgctgtgcttgtagaggtcgctgttcgtatcgaaattgttgacgttttgccagaactttgcggcgccccacacacttccatagccatcggtgagtttgctgctgccgccaatatcgccgcgctcgacgttctcgagcttgtcgcgcagagtgtagcgattgccatggctgccgttagctgccatatagacctcgctgcgcgtggcaaacgtcgtgggggtatcggtggaataggggccaacggtatcggccggaatgtcctcgctcgtgcccaggcccaaatcgctatagtcctgctcggtcatatcggtgatctcaggcgtgtcggccgcctgggcgacgttgggagccgccgtgaaacaggcgacgctcgttgcgatcaacgcagcaagcgccgccgtcccggcaagcgggattttcgacagcctacggatacggggatgtggaacgtacatgagggacctcgctttactcgagtggagtggactcatttttgcaaatgatacgtccgacgcccgatatcacgtgtctcattttcgccaacggcgtgtctcatttttgagaatccgagatgccgcggaaatcttatcccagctcaaaggccatttctgggatgtattttccggttttgctctcattgggaaaatcccgtttcttgaccgaataacgggatgcaatttcccgttggagcgcctttgggaaagtgtgtcccacttcgaacgcccagagtgggacgcactttccgcaaagcacctcaacgggaaactacgtcccattccaaaggcaaattccgggacgcattttccgaaagcctgcccatccggaaagcccgtcccactttggacgcatccgggcacggaaccatcgacctatcaggcctcccatcaataaagaggcgccctcccggacgacggggcacgaagctcatcgcgagttccgcgcgcaaagaaggccacttaatgtggccttcgtcttgcgcaggactgtagagcagggaacttcgtgccccgacgcccgggaggacgttgcatttagaaagatgaaccgaccgccgtcagcgatgggagctactcccccagcacggccttcttggcggcggcagacatgtcctcgaggtcttctttggtgggatgatcctttgcggcgacccagttgtcgagcagcatcttaaagcgcgcgttgtcgggatcttgctcgagcatggcctcgtagcgctgcttgaccgcgggacccatcttgccttgacacatggcccagcccacgagctcggcatcatcggccaaattggaggtcacgcgatcgataatctgctgataatagctctggtcggcaccaaagccgcaggtaccaaagaggaaaacgcgcttgccgtgcagggcggagagcagcgccgcgaccgaaggcgtgcatgcacccttgttgttctcctggaataacgccgaggccaaggacaaggattaacgatgcggcagaattatcgtccgacggcaaccgagttcacctacaattgccaccggatcgaacaacgcaaactttttaggaagtcattatgacagctatcgatcgaacgcgggcagccagggccttcaagacctataccgatgcctacgatgccaccaatccgcgcatcgcgctcaaaatcgaacacacctatcacgtggcggaagcgtgcgatgccgtggcgcgcgaacagggctggacgccgaatgatatcgacctggcctggctttgcggcttgctgcacgatatgggccgctttgagcagctgcgacgctgggacacctttaaagatgccgagagcatgagccatgcagcgttgggcgtcgaggtcctctttggcgagaatcccgccgatgcaccagccgcaacgagcatccgcaattttattgaggccgacgagaacgacgagctcattcgcgcgagcattgcctatcacagcgatttccgcctacccgaggagctcgacgagcgcacgcggcgcttctgcgatatcgtgcgcgacggcgataaggtcgacattatgcgcaccatcgccgacagcaccgtcgatactatcctcaaggtggacgagaagacgtttctcgccagccatttctcatcgccgacacttgacgcctttgacgagcgtcgctgcgtctcacgcgatgagcgcaacgaacctgcagacttcctggtagggctcatctgctttatgtttgaacttgtctatcccgcaagtcgcgcgctggcgtgcgagcagggcgatatctaccgcctgctcgacgcaccctttggcattacgcggcctttcgccgatcccaccacacagacggcctgggagcgcctaaaggacgagatgcgcgactggctggcgcgtgcctagcgctcaagctgggccagcagctcctcgacgacctcgacggcgtcgccgacgaccttatactgggcggcgccaaagatgggggcgtccgggtcctcattgatggcgataatgcactccgccccgccgatgccggcgagatgctggatggcacccgagacaccgatgctcacgaggagcttgggcgagaccgacacgcccgtctggccgatctggtggcgatactccagccagcccgcctccaccacggggcgcgtgcagccgagctcggcaccgagggcttcggcaagctttctcatcaacggaagatttttcttggagccgataccgcggcccaccacaaccagacgctcggcatcggcgatcgaggcctgctgtccccactcctcggcagggattgagatctcgacacgagccttggcgtcttccgcaagcgctacttgggtaatcgtgccggagcggccgtagtcaaagtcgggcgccttaaagatgccgggacgcaccgttgccatctggggacggtgattgggacaaacgatggtagccatcaggttgccgccaaacgccgggcgcgtctgctgcaacaggcccgtctccgtatccatcgaaagcacggtgcagtcggccgtaaggcccgtctgcaagcgcacggcaacgccgggagccaactcgcgcccaaaagcggtcgcgccgtacagaatggcctcgggcttgcgctcggccaccaaatcgcagatcaggcgggcgtagacctccgcgtcgttttggcgcaggcgctcgtcgcgacagaccataacttcgtctgcaccggcacagaccagatgctccagctccccaagtgagctctcgggacccatgccgaccagcgccaccagacggcagccacgggcattggcaagctcgcgtcccttgcccatgagctcataggccacaggggctacggtgtcatgctcgtcagtctgcacaaatacccaaatgtcttggtatgcgtcgagatcgactgcgtcagtggcctcatcgcgttcaatcgagatagcgctgaccggacaggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcacaggatgcagccgtcggttacgcgggcgcagcggtttggccgctcaccctccaccacaataccgcccgaggcgcaggcacgaacgcagcgaccgcagccgatgcaggcttcgctatcgataaccagtccgctcatctatgccatcccctcgataatcttggcaagctttgccgcctgctcggtcggtttgccctcaacggcttcacacgtttgatcgcggtcgggcacaaatgagcgcacgacctgcgtcggcgagccggcaagaccgcagcgcgcagggtcggcatgcacgtcggcagcgttgaccacgcgcacgtcagcctcctcagccgcacgaataccggcgatgctcggcatgcgcagctggccgatctcctgagcggtcgtcatcgcacacggcatctcaagatagaccgtctcttcgccggcatcgcatccgtgaacgagcgccagcgaaccgcacgtcgtaaagcccgcgctctgcacgcagctcacatcggtcacgcagggaatctcgaaggcgccggcaagctcgggaccaatctgggccgtatcgccgtccaccgccatcttgccgcagataagcaggtcgaagtcctcgtcgagcgcctcgataccgcatttgagggcatacgtggtcgccaaggtatcggcacctgcaaaggcgcgatcggttagcagcagcgcgtcgtcggcgccacgggcgatgcagtcgcgcagcagcgcttcggtcgcgggaatacccatcgacaccaccgtcacgcgcacatccatgccaaagccgataaagtcgtccttgagcgccagcgcgcactccagggcactcgcatcaaagggattgatgaccgcctgcttgccgtcgcgcacaatggtattggtcttggggtccatcttgacctcggtgcttcccggcaccgccttgacgcacaccaccatatggaaatcgctcatcttcacgcgccccctttctggacgagttcatccaagagcttctccgaaaacaggttgccgcgacccagctgtccggcaggatcgagctggagcttgagccgcgccgattcgaccatggcctcgtggccgtacaccgtctcaagaaagcccgccttgatcttgccgacgccgtgctcagcggagacggcgccgcccatagccgtaacttcggaggcccactgggcaaacagctcgccgccgcggcggtaatcctgcgcatcgcgcggcagaatgttcacatgcagatggttgttaccaatgtgtccccaggcggcagactcgagcccactttcggccaatgtgcggcgatagagggcgatgacatcggccaggcgcgcgttgggcaccgacatgtccgaacccagcttggtgatggtggggtcggtgcggcgacgctcgtcgataagcatattgacgctctcgggcaccgcatggcggaagaatcgctggcattcgcgatcgacctcggtgcgcgcgacccacgtcgcatcgtcgcggccacctgcaagctccagcacccaacccaagtgatacagctcctcggtcgcttgggcctcgtcgtcgcagtcgagctccacgtagacgcagaccttggcctctttgtcgagcgccggcagcgaagaaaacgccgtcgactgctcacgctggcggcgcaggatatccagggcgcctgcatcgaaatattcgatggcggctgcatgggataggacgggacgcacggaatcggtaaaggacacggccttgtcttcgctgtcaaagaagcagctgacgccccatacgaccgcaggcgccgcctgcaggacgatctcaagctcggtgatgacaccgagcgtgccacacgcaccgatatagaggtcgatggcatccatgtcatccgcaacaaaatagcccgatgcgttcttggtctcgggcatggtatagctgggaagatcgaactcgagcgcacgaccttccgctgtcacgagtgacaggtggcgaccccgggcaaaaacctcgccgcgctgaagctcgaccaggtcaccatcggtcagcgcgacatgaagacccgtgatgtgggggcgcatgggaccgtaagcgtagctacgggcgccagaggcgttgcatgccgccataccgcccaagcaggcagatgcctcggtgggatcggtgggaaagaactgctcgggggcttcttgaaattcctcgtaagccttaagtgaagcctggtcccagcctgcggtcgggagcatcttcttgcccagctgcttgcgcagctcggacagcacgacgccgggctcaacacgcaagagaaagtggccctcgtcatcgcgacgaaggccaaggtagcgattcatacgggaggtattgaggatgtggccgccatggggcacggcgccggcggcaagaccggtccgggcgccctgaaccgtaaccgagacacgctcggcatggagctgccgcaggatggcgcaagcctcgccttccgatgttggaaacgaaatgctcgaggcctcgcccgacgagcgagactcgtcgcgaccgtattcctcgaactcatcggtgaagggtttgatggttgcagacatgcagaactcccctttagctaactacagtgtttgcagggagatgttaccgcatcgtttcgttgacgtgttcgagaccgtctccataattgaggatttttacgttcgcgcaattcggcgagcggccgctagatctcggcaggcgatgtttttgacacatatcgctttgccgccaacgatcgcgaaattggcactcaaaaaatgttgaagtattttttaccacctattacctgcggtgatgcaaatccgtcaagcatttggtcagcttttggtcaagtagtggctgatacggtcggcatcgacagccaaaccgagagaagttttggccccagaagcagggaggttcccatggcatattactggccccagtacggcgtcgccatcgaagtcgacgacgatccctatctcctgcctttcgacgaagaggcattccccgatacggcggtctaccacgtcaccacctaccatgagcttgccggcgagattctcaagaacgtcggcggtatcgagaacgtcaagagcgttcgccattgcatcacgcgtctccgcttcgtcctcaaggacgagaagatcgccaatgacgacgtcatctccaacctcgatggtgttatccaggtcatgaaggccggcggccagtatcaggtcgttatcggagccgccgtggatgatgtctacgaagagctcgtctccggctacaaggtgcccggtgtgggcgctgtcgccgcaggtgatgagcctgacgaagccgaggacggcaagaacaagaacgtcttcaacatgctgatggacaccgtctcgggtagcatggctcctacgctcatgccgctcgccgcggccggtatgatcaagggcctgcttgccctttgcatcgccatgggctggctcgccgccgacagcggtacctatatgatctggtactccatcgctgacggcttcttctacttcctgcccatcatcctgggctacaccgccgccaagaagtttggctgcaacgagtttttgggtatggcgctcgtgtatccggccatggtcaacctgagcgcctcggcagaggttatgggcacgctcttcgagggtaccgcgttccagatgagctactacaacacgttcctgggcattccagtcatccttcccgcgtccggctacacctcgagcgtcatcccgattcttatcgccgtctgggcggcttccaagctcgagcgcagtcttaacaaggtcattccgcagctcatccgttccatgtccgtgccgttcctgtgctttgccgtcatggcccccgcgacctatctgatcatcggccctgtcgcctccatgatctcgggcgtgctgaccctcatcaccgaaacgctcatcaatatccccgtcgttggcggtgccgtggtcggtatggtcgtgggtggcgcgttctccacgctcgtcatgttcggcctgcactgggccatcatccccatcatgctcaacaacatcgccatgctaggttacgacccgcttatggcggccggttccatcggtggcttcgtaggtgtgtcccagggcttggcggtcatcctccgcaccaagagcgacaagacccgcaacgtcgccatcccggctacgatctcgcagttcttcggcgtcggcgagccgctgctctacggcatccagcttcccagcaannnnnnnnnnttcctgtttgtccagaacatcgtgttctctgcaatcgccggtctggtgatgggtgcccttaacgtccacgcctacagcatgggcagcgccggactcttcggtatccccacgttcatggaccccaccggtgccgacacgagcaatatcgtgttctacctgggcacgcttgccgtgatcatggtcatcgcctttgtcttcaccatggctacctatcatgacgacggcagctacctgggcaagtcccgcaacaaagagcaggcctaagcaactgcgcttttcatagttcccagccagtgcggcgatccaacgtggcgggtcgccgcaccgtaacttcccgaaaggtcggatccatgcagcctgatttgttcgacgcccgttggatttcgggtgagccgtttgtctatgagccggcggaatcgtattacgacgagtgtcaccgcaaccatgtcgtgcgcggcacgttcgatcttgagctggtgcccgcgtcggcggtgctcacgatcgccgtcttgggctacgcgcgcgtgcgcatcaacggcgtcaggatggatgcatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcaatccctcgccgttgacgctctttggcaagtataacctgcgcgaacgtctggtcgaggtcgggaccccgcgcgctgcgtgcgcgattgtggcggccggcggccgcgtgctcgccaagaccgacgcgtcttggacggcgcatacaggcgagctgctgttcaacaacgtgtatctgggcgaggtgcgcgacttgcggccggtgcccggggatgcgttgccggtgacggtttatgacgaggtgcgggctatcgagccctcgccggtcgcgccgtgcgtgcgcgacacggtagtggagcccaaacggattttcgagcacgaggacgccgtcatcatcgactttggcgaggtcgttgccggattcatgaagctgagtgtggaagcagacgaggggcggcgcatcgagcttgtctatgccgagacgtggcgcgacgggggtccgtatgcgggcacggcagtggcgggttatgccggcatggagacgccgcgcggcgtgtgcccgggtggccctggtgctccggagcctgcggtacagcgcgacgtcgttgtgtgtcacgcgggtgaaaacgtgtttgaaaacgagttttgttggcattcgtttagatatgtgacgttaaccggatgcgatgtcgcggcgattcgctcggccagggcgacgtatgtccataccgacctcaagcgctgcggtaagctatcgctcggcaatgacgccttcgagcgacttcacgacgccgccattcgcaccaagctcaacaataatcacggtgtgttcgaggattgtgcgcgcgagcgttttggctacggcggcgacatgatcgcgcttgcggcctcgcagatgttctnnnnnnnnnnnnnnnnnnnnnnnnnnnnnnnnnnnnnnnnnnnnnnnnnnnnnnnnnnnnnnnnnnccgaaacggctcccttcatgggtatcggatccaatggtcctgcctatggagagggtccgctcatgtggcaatttgcccatccgtacctggcgattcaagccgaccgtatctacgggcgtcgcgatttactcgagcgtgagtggccggcgatcgagcgttttggcgactatctgatgggtttcgatccggcggagctggcaccgcactgcctgggtgaccacggcagcatgattgcgaagggtttctcgaacggttctcccgataaggagtttgtcggctggtgtgcgattctctggggtttgcgtttgacgagcgaggctgcggggcgtaagggcgcggacggcgtgcgttttgagcgtgctgcggaacaactgcgcgccgagatcattcggcgctttcgacatgccgacgggtcatttggcgacggaacgcagacgtcctgggcgtttgccgcggcacttgagcttggcgatcagctcgaacttgtcgagcgactggcgcgggcggtcgatgccgagcgggtgctaacgaccggcatcttcggcacggctttcgcctttgacctgctgtcgcgctgcggccgcaacgccgtgctcgagcgctggttgctgcgtgagcaggggccgagcttgctcagtatgctcgctgacggcaacagggcgcttatcgagatgttcgacgatccgctggcctcgtacgaccacgctatgttttcgagttacgaccagtggttctacgaggggctcggcggcattcacgtgagccgtgatgcgcgggggtgcgatggcgttacggtgcgtccgtatctgtcgcatgcgaccgatacgttcttgtgctcctggcagacggtgcgcggcgagatccgcgttgcttgggagcgcacgggcgctggggtcgcgattgatgtaacggtgccggaggacatcgaagccacggtggaggcgccgctcgagggcaccttgcttgagcgtgtgaccgatggctcgacaacgcatatggttgttgagcagctcgttcgttagaaatcctggggggagggactcatgaaatacccgcatctgttttcgcccatcaaactgggtgatgtgctcgtgcaaaaccgcatcgtcgccaatcctatgagcgagcattttgaggaccgttgtctgggcggcgccggtatcgtcatctgcgggcataccatcgtggagcccgggcgctcctcgtggatgagtgccgacgagccgtacgtcttttccaaatacgctcgcgaggaggctgtccgtcgtgctcgcatggcgcgccaggcgggcgccgtcgcgagcatcgagcttgcgcatgccggactttacgccnnnnnnnnnnacgatcgactacgccatggggccggacgcctttgtgcgtgaggatggcgttgaggttcgcgcgatgacgcccgacatgatggggcgcacggctgcctgttgggcgcaagcgtgtgtcgatgctcgccgcgccggctttgacatggtgtttttgcactttggacacggttggcttattgaccagttcttgagccccctattcaaccatcgcaccgatgcatatggcggctctatcgagaatcgtatgcggtttccgttgcaggtgttgcgggcgtgtcgcgatgctgtgggaccgcgctttcccatggagatgcgcatctcggcggatgaatgtatgccgggaggcatcgagcttacggatgtcatcgcgttttgccgtgaggctgaacggtatgtgacgagtatccaagtctcgtgcgggctcgatatcgagcatgaggccaacgtccatacctctgccaccaacctcgatccgcacttacttaacgcgcatcttgctcgtgccatcaaggcggagatttcggtaccggtgacgctcgtaggctccgtcgagacgccggaggaggccgagcgcgcgatcgccgagggcacgtgcgacatggtggcgcttgcccgcgcgctcgccgccgatccgatgtggccggctaaggcccgcgcgggccgtgcggcggatatcgtgccgtgcctgcgctgtctgcagtgctatcacatctcgaccgatcgttggaacgtggggtgcagcgtcaacccgcgttttgccaacgagaattttattccgcgtgagcaacaagtatcacgccatgcccacgcaggtctccatcggcgcgatcaaggtgctcgagggacgcgagctcaagaaggacgagtttagctttaagctcgctggtgaggacgtcgagtccaccgtcaccaacgatgccgacggcaagatcggcttcgacaagttcgagtacagcgagcccggaacgtacgtctacaccatcagcgagatcaagggcgacgaggccggcatgacctacgacaagtccgtctttaccgcgaccgtcaacgtggttgatgacggcgagggcaacctcaaggcgagcgttgcctataccaagggcgacaagagcgtcgagggcatcgtgttcaacaacacgtacaagaagcccgaaacgcccgtgccgacgcccgaccccggcacgcccaagaccgtgacgaacatcgtcaagacggtcaagggctatctgcccaccacgggtgaccagcaggcagccgcgctgctcgtggcatttgtcatcgccatggctggcgttggagccctggtctggggtatccgtaagcgctaggcacgtcgacggagcctggggccaaaaggccccgggccgccggcggggagccagaaacatagcccctaccccacccccagccgccacggaggcatctccctcctccgtggcggcacttttgtgcgaccgctcataagttgcggtgaaatacggactgtttggcggccctagggggcacagcagtccgtatttcaccgcaactgagtcgccgattctttgagttatccgcgcaggtaggcgatggcgatttgggtgcggttgcgtagacccattttggccaggatcgagctgatgtggttgcgtacggtgccttcgcccatataggcggtggcggcgatctccttgttgtcgaggccgcgggcgatgagctcggcaacttcgaattcgcggtcggtcaggccggtaaaggctgcgggccggcgggacgcgcctgtcttgtcgcccatcccgtcaaagtcaacatcctcgattgccttgccctcgagcatgcgcttgccgtccatgacctgcgccaatgccggcggaatggcggcgacatcggtcttgatcaggtaaccgcgggcgcccagcttgagcgccgacacgatgtactcgtcatccgaaaacgtggtcaggaacaccacgcgtgctgcggggtcgcgctcaagaatctcgcgtgccgccgaaagcccgtcgcgcctcggcatctggatatcgagcagcgcgatgtcgggcgcgtgctcggcatagagcgcgaccgcgtcgttgccgttggcgccggtgccaaccacttcgatctgcggctgggcacccaggataatcttgagcgaatcgaccaccaagcggtcgtcgtcgacaacaatgagcctcatcgggcctcatctccttgctgtttgggaacggtggcaaacacgcgccagccggcggcgccggcgcgtgggccggcggtgaaggtcccgccgagcgcctcgacgcgctcgcgcatggagccgagccccatgccttccgcgacgccgcgactgcacgcccggattccgccctcgccatcgtcggtaacgatgagctggtaaaacgacggatgctccatgcatcgcacggtaacgttctgcgcgcgggcgtggcgcatggtgttggagagcgcttcgcgcaggaccgccgcaaagcagttgacgacgttggccggtgcatgctcggccaaaacctcaagctcgatctgcgggccgccgtccgagcgcacgtcctcaacaatgcgctcaagctgtacggagaggtcggcggcgttgtcgttgagcgcgtggacgctggcgcgcacaagctgaagcgcctcgtcaacggtgcgcttgacgtcggcgaagtcggcggcgacgccgggttcgttggcgtggaccacgcgcagggcttcggtttgcagcgaggcgcgcgtaagttggtggcccacattgtcgtggatctcgcgcgcgatgcgggcgcgctcggcaagtgtcgcgagctcgacctcgtagtcctgacggtcggcgaggtcgcggttgcgcgcctcgagcgcgagagttcgttcctgcagcccgtcgcggatgcggcgcatgcgctcctgctcgcgctcgagctgtgcggtgcgcagtgacagcaaggtggcggcggccgaaaggatggtggtcagcaggagcgttcgggtggtgagcgcgccggcgcgaaggtccgcgacgagggcgaaggcaaagatgatgccaatgcccagcgcaggccaggcgtgctcacggcgcacgcgtcgcgcgatgtcatagaaggcgaggggcgcaaacggcataaacgacggtacaaagacggccacgatgacgtagacgtagctgccggcctcactggcgcggcgggcgcgttcgccttgtgcgacttcggccaaggcggtgatgataacgccaaggcaaaacgctgcgaccaagcgcgcgtccacagcaaggcctaaggcggctgcgatacagcacgccagcacgatcgatttgtcgaatagcctgttcatacgggtattgtacgcgatggcgcgcacggcgaagacgccacctggagcaaccgtgacatttgtcccagcaagggggaccgcgactatgtctcgccgacaatcattttaccggaacatttttgatagctgtatctatcatttttgctagatatagctattatttttgctagatagatttatcaaaaggaggctctaggtgtataggcgcaagatatcgaccgtgttacagcaaagactcatggggccgcgttcctttattcaggtggttatgggtcccaggcaaactggcaagaccacggctatcaagcaggcggccaaggcttgcgggcttccgtgtcgcgtggcgagtgctgactcgtcgcgcgaactcgcgggggattggatcgaccttgagtggcgccaggctcggcagctgacaagtaatggctcgcgtgccatccttgtgctcgacgagatacaaaaagttacgggttggtccgagacggtcaaggccctgtgggacgaagactcttggaacgacaccgagcttcttgtggtgctgtccggttcgtcgagcttgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgtttggctatagcttcgaggattatctgatgtttggcgggtatccgggtgctgctattctcaagaacgatgtcgatcgctggcgcgagtatatgcgcgattcaatcgtggaatcgacgatttcgcgtgacgtattgcagatggaagacgtgcgcaagcctgcgctcatgcgagccctctttgagctgggtgcgcagtattcggcgcaggagatatcgtatcgaaaactgctggggcagctcgacgataagggaaacactgataccgtgcgccattatcttgatctgctgtccaaggcgggcatgatgagcgggttgcaaaaatacgacgccaagcaggtgaggtcgagggcaagctcgccgcgactgctcgtgcatgatccctcattaatgttctcgatgtggcgcggggcgggtgacttgttggctgattctgccctgcgagggcatttggtcgaaactgcggtgggcgcccggctcatcgcgcgtgctcaaacagaaggctttgagctgtattggtggcgtgagggtaatctcgaagtggactttgtggcgaagcgcggcgatgacgcccttgcggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgggcgatcgtaacgtttcggttgagcagttcttgcgggatgaggtggagctgttttagctggtgattgctacggcgcgggcgggtcaaagtgatcagaaatgcaagccccacttacttaagatttgggacaaacacatctgattgctttgtcctgtggcgatgccggttctgttggcgccgcactcgtgacaaagctcactggtgcggcccgcctgctcctgcgatgatgcaatcgtaccgggccgcaatcaacggaaaggccgcctcatgacagacatcgtccacgtcgaaaacctcgtcaagcgctatgacgaccttatcgcgctcgaccactttaacctgaacatcgcccctggcgagatctttggcctgctcggccccaacggctcgggcaagaccacgtccatcaactgcatcctgcagctgctcgcctacgacaagggcaccatcgagctgttcggcgagcccatgacgcccgtccgctacgacctcaagcgccgtattggcgtggtgccgcagcaggtggcggtgtttgacgagctcaccgtgcgcgagaacatcgactatttctgcagcctctacgtcaacgaccgtaatgtcgagaatctcggcggccttggcgtccacggcagtctggtcgtcgatgctgtcggcgatggcccacatcttctcccagtcgaactgcttggtgtagaggcccagacggttgtagaggttggtctcgtcgatgtagaggtccatcatgcccgggtacggacggccgatctgggcgatgttggtgcggcgcaggcgacgacgcacctgagcggcacggcaccacnnnnnnnnnnnnnnnnnnnnnnnnnnnnnnnnnnnnnnnnnnnnnnnnnnnnnnnnnnnnnnnnngtcgccaccctcgacgacgccggtcaccacggcgtgacgcttgccggcgcggttaaggtcggccacgacctcgccgggggcaccgcaggcgtacaggtcgcccagccacgtgggaatgtcggtgttggcgtaatcgggctgagccttcttctgcacgttgaccacgacgacgggcacgtccaggtcacgcacgaccggcagcacgttgtagctcgtggcataggtgagcatctgcaggatgaccaggtcgacatcctcggcacggaacttgtcgcccgcgacctgagcctgctccttggtggtcaccataccgccgtcgataagctcgacggtcgtgggcagcgtggccttaaagtcctcgtactgctgctcaaaattgggaacgagctgcgggaactgcggaagataggcacccagggcaatcgagaagacgccaaccttggccttagtgttaacgagcatgatttcctccaatgcgccgtctcactttcttgttagtcaacaaatgcgtcgttgatcttgatgttgaagtcgcggcaggtgtccttgaggcccttgtcgctgatcttgttgaggaagtcgtccgagccaccgttggcagcgcgtgcggccaggtagatctcggcggctttctcgacggtgtgcgccaggccaaaggtcgtatcgaagtcggggccggcggcgaacaggccgtggtgagcccagacgatggtgtcgtaggtcttcatgagctcagagctcgcctcggcgatggccgggccacccgggaccatccagggcacaacgcccacgccggccgggaagacgacgacgcactcggtcatcatctgccacaggatgcgcgtgaaggcgcgatcctccagcggcaccacgaaggacatctcgatgatgccgggggtgtgggcgtgatagattacgcggtcggcgccatcggtacgggcggcagccacgcagtggttcatgtagtggctctcgaactcactggtcggacgggcgccattggcaaggccccagacgatgcggaacgcgtcgccggtctcgttgatctcgacgatgccgatgttggcatgcggatcctccaggacgttgcgcatgtacttgcccgagccggtgctcacgaagtactggccagcgaggttctcgccgcgcacgcccatcttgacccactcgcggggctcctcaaagaacggcttggcctcggcgacctcctcgtcggtcatgcgataggtgaggtttccaccgttgcgctcgtgccagccctgcttaaagccatcgtcgcacaggcggcaaaagcccttgatgaacgccagatcttccattgccattgtttttctcctctccggggcccgcgggcccaattgaaaaaacgtgataagccgattgacggcggcgcggagcatggtgtcgtgtagggcctccgcgccgtatgtcatcggagagagccgctcgtgtacagcaggagtcaattgccgtccgcggggctgggggtaggtacgtgacgaggggcgcatctcccctctcggttaggcctggatgcccttggggtcgatgcgcttgacannnnnnnnnngcaggcacgggcatcggccaggtcggcaatgtcgccgccggcgatcatctgcacgataaagttgccgatgcaggtgccctcgatggggccggcgaacacgggaagcccgcaggtgtcggccgtcatctggttgaggtagtaatcctggcagccgccgcccacgatattgatgctcgtgtaatcgtgacccgaaagctcgcgcaggccttcgatagccttggcatacgaacgggacaggctacagtaattggtgcgcataatctcgcccacggtgtgcgnnnnnnnnnnnnnnnnnnnnnnnnnnnnnnnnnnnnnnnnnnnnnnnnnnnnnnnnnnnnnnnnnnnnnnnnnnnnnnnnnnnnncaaaaccgaccttgtggtccatgagcgccttgtgcgaggtcttgccctcgacgtagtcgacgccgttgacctcgcgacggacggactggttcatccacaagcccatgatgttcttgaggaagcggtagcgcttgagatagccaccctcgttggtgaagttctgcttgtgggcgagctcattggtaatggcgtgctggttctcgacgcccagcaggctccacgtgccgctcgagatatagacggcgttgtcgtccttggctggcacggccaaaaaggcggaaccggtgtcgtgcgtggcgggcagcacgacggttgcggagtagccgatcttctcggaaatgtcggccgtgatctcgccgagcaccgcgccgggcatggtaggctccaggaagatgccctggggaatgccaaagcgcgcaagaatctcggtgtcccacgtgcacctctcggcatcgagcatgccggtggtgctcgcgttggtgtactcgttggccttgatgccggtcaggcgccagttgaggtaatccggaatcatcaggaaggtgcgggcggcctcgagctgctcggaatgctcattcttaagggcaagcagctgatagagcgtgttgaagggctggcgctgaataccggtgcgggcatagacctcagccgggtccatgatctggtcggcgacctcgtagatgccgtcggtacgagcgtcgcggtaagcgaccgtgtcgccgacgatctcgttatgctcgtcgagcagcacaaagtcgacgccccaggtatcgataccgatagnnnnnnnnnnnnnnnnnnnnnnnnnnnnnnnnnnnnnnnnnnnnnnnnnnnnnnnnnnnnnnnnnnnnnnnnnnnnnnnnnnnnnnntctggtccttaacggcacgcaggcctgcgacaacgtggtcgaacagggcctcgacatcccagcaatcgtgtccgttaacgcgcttttgctcgttaacgaagcggtagacctcctggtaggacatcttgccgtcctcgacccagccggcaagaacacgaccgctcgaagcaccgatatcgaccgctgcgtaatgcttggactcgatgcgactctccatgtgctttcccctttttgaagcggttcatttacggttttcattattatttgaatcgtttcaatttcaatatgagtcaatttcagtccggcgagcggttgtttctagccggtgaacggtagttctgggtcagaatcttccacacagacagagaggcggccgcccgcataacgcggacgaccgccttttaaaatgaaattgaaatagatggtatgccagcgctagcgcacggccttgaccgccgccgtcagatcgaacagcgtgtcgagcacggcgtcgcaaccgtccaccacgtcctgcggcagcgggacgatatcgggcacggcaaagacatggcagcccgccgtgatacccgagacgcagccgttgcgcgaatcctcgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaggttgcgctcggcggtaacgtggcgcgaagacgtcgcaaggcccacgtgatagcccgcagccaaaagatcgtccaggcactcggcagcgccggccttaagctccagctcggtcttgaccatctcgtcgcgaatctccttgtggcgaacatagagcgcgtcggcagtttcgtggctgccgtaatgctcctcgagaatgcccatgacatcgggcagcgtgcgaccaataaactgatgaatcagcgcctcatcaatcgcgagtcccagctcaacggcacccgctttccacgccttaatacccaagcgctcggtgtccacgagcgttccgtccatatcaaaaatgacagccttgatcatttcggtccccccatcggcttgcattgccgctactctaccgcactttacaaacttgtatataacgtatatacatattgcactttcgttacatagatagatgtcttatggcgagcggctcggtaggattatagtttcgtccgagcttttaactgtaaggaacgtttcatgctttcagacaccaccgcacccgcagaggagcttcagaacaaactcgcagcactcgaagagctgcttttggcaggtgttgtcgaagacgaccgaccactgcgtgttgctggtgatgtcttccggattgggctcttgcgccgcagcgcgtagggccttccaagcgactgcctcgtcttgggcaccgacatgggcgtcaaggacatcggcgattgcgacggcgcgctccttaccatggcccagctcgccattcttttggttgggcagcacttcgtcgccatagcaggcgtagaagttcgtaacctggcgtacgggcgtcgccttgcatgcacggtcgggatcgcgcggatcccactccaccacccgcgcgtcaccggcggcgtcgttgataaagaannnnnnnnnnnnnnnnnnnnnnnnnnnnnnnnnnnnnnnnnnnnnntcctgcgtggtggccgcgcggtcgagcaccagacggatggcgagcgaggtattgatgacggggcgttgcgtgtcctggtcacagggcttggaatccagggtgagtacggcaacggacacgccgcattcgttaacaccatcgagctgggcaaacgggcccatgagtgcggcggcgcgtccggcgacggagtcaagcggagtgttatcgcccaggttgttaagggcggcaaacccgatggaggcatagccgtcgcgcgggtgattgcgcaccagcagcgccgaggtgtcgtccttaaagtcgtaattgcgaccggtgcgcacgcggccttcggcatctacggcgacaaaagcgctgcaggcaaactggggcgcctggacatgtgccggcacaccgggcagcacctgcgccaccacggcatcgatgtaggcctggtcgtcgcgcacgccagcggcgatgatgcgatcaagatcgtagtcgtaggcaatgtcgattgcgtacaggtcatagccatccgcgtagccggtcaagcgtttgagcgacgcggcggacttgatttgcttgcggtaaacgatgccggcggcagcggcaaggccgacggcggttcctgcaacaccgcaggtgatggcaatgatacgtggcttcatgaggactcctctcaaagcgatgctataggcattatcgcaaatgtcatacagaccatatgccgcattccggcgagtggcatggcataccgagccctagagcagcgcaatcgcaacgatgcagcatccgagcgccagaacagcaaggtctgcccggtcaaagcgatagctgcgcaggcaggttctgctgacagccgggtgcgctccgtattcgcggttgaccatggcgagcgcgagcgtgtcagagcgccgcagcgcgttgctaaacaagggcgtgatgacgggaataaaagcacgtgcacgctgcaggggcgagggactgtcaaagcgcgccaagcgcgcttcctgagcggccttgatacgattgaactcttcgataagcacggggacaaaacgaagcgtgagctgtatggcgacggtggcatcgtcggtgcgcaggccaaaacgggcgaggggcctcagaagcgccgcggcgccatcggcgagtgcggtgggggaggtggtcgccatgagcgtcgacgttcccagcataatgagggcaaaacgcagcacgcagagcgcgccaaagagcagacctcccgaggtgatctgcacgggtcccgcctgcagcagcagagtccccgatgccgtaaagagtgcgttgaagaccaggacaaaccccataagccagcgaaatggcctgggggcacgaagtgcctgacgcatcgagctgccgcttgcggcgagcgaggcgaatgcggtgagcgcgacggcggcaagggcgccgggctgctgggcgataaagccggcaatcataaagagcatgcagaatacaagcttggtggcggggtgcagcaggtgaacgaggcttgaccccggacgaaagatgccaaacgagaccgccttggacgctggcggagtatgtccggtttccacgggacgtgcggccgtcacgccaacggatgtcacctggatgccctcggaactttgcggcagcagcatgccgtcctgcagccgaaaggccttgtcgcannnnnnnnnnnnnnnnnnnnnnnnnnnnnncacgcgaatcgtgcgtggcgattacaatgccgcggccttggcgtgcgagttgagccaagcgctcgagcagcagccggtgggcgcggggatcgagtccagcgctgggctcgtcgagcagcaaatacggtgtctcgagtgcaagcatatcggcaacggcgatacggcgctgctctccgccagaatgggcaaaggggcttgtgtcgccgatagcggcgagatcaaacccgacgctggcgagcgatgtgccaacgcgtcgcttgacctcggcttcgtccagtccaagattgcgggggccaaacgccacctcgtcaaagaccgtggcggcaaaaaactgctgctcggggcgttgctgcacgagtgccacggttttgcggtacgtacgaagttcannnnnnnnnnnnnnnnncgccgtggggtgtgtgccaagcgcggtgccgtccgccacgacagaccccgcctgcacggcaagcgctccggcaagggcacgcagcagcgttgacttgccggagccagaggtgcctgcgataccgatcacgctgccgggcctaatttccaacgaaacacgagatagggtacaggcgtctgcttcgggatagcggacggttatgtttgagcaggttaacgacacagttcctccaggccgcatcgaatgagcagatcgcgctggtcggcaagatcttgcacggtacccaggtatgcgatggcgcccgcctcgaagacggcgactcggtcggcgcgcgcgacctcgtcgagcaactgcgtgatctggatcacggcaacatcgcgctggcaaagatgatcgatgagatcattgacggcctcgcgggcggtctcgtcgagcatggcggtcgtctcgtcaaaaatcatgagcgaaggggtgagcgcaaccaatcccgacgccgccacgcgttgtttttggccgcccgagagcgtggcgacatcgcgttgctcaagctcgacaatgccaagctcgttgagtgcctgcaagacttctgaacgcatttcgtcgcgggggacaccgcggttttcgagtccaaaggcgatgtcgtctcgcacgactggagcgacgatctggttatcgggatcctgaaaagcaaggcctacggtgccctgcacgcacatagcgtgcccgttcacgtctttgagcagccccgcaagctcgagtgcacaggtgcttttgccactgccgttggtgccgacaaaggcgatgcgctctcctgccacgatattggcggcaagtgcagcgcaatcgacggagggacgtgtgtcatcggcttgctcaataccggcgagcgcaccttctgccaccgcgcccgtaatgccgccggtgacgcaggcggcgacgcccagaacgcccagattgataaagactgccggggtctgcagcgccatggcggcaacgcccagctggcctacattgtgcagcacggcggcaagcatgctcacgggcaccaagccaacacccggcacggcagcaagggcgannnnnnnnnnnnnnnnnnnnnnnnnnnnnnnnnnnnnnnnnnatagacgagcatcatgggcgaaccaaacaaaaagcccgatgcaaagaccttaacgagcgcaacggcaccggcgcttttggcatcgagcgtatagagtgcgacgactacggccacgttggcaaggcccagtttaatgccgggcaccgcgacgggcagcggaatcatggtctccagataggacagcaccaatgcgcaagcgcacaacagcgaaacgcgcgccaggcggcgagtgtgttcgatatcgaccatctccacggattagcgccccactacgtcgtaggtggtctcggcgctcgcgtcgacgatatcgacggtaagcttgtgcggaaggcagacaatttgctccccggcagcgtcaatccagccctggtgcacgcagtcctggttgggacagtctgcttcctcgacgtgcacgcggccgtctttgatttcgatgaggttggttcccaagtcggtcgtaacgctcttggtcgtgttctggctcagaggaagctcgtagacgttttgctctccatcgcggataacgactgtggccgtgtcggcgttcgtgtttgctcccatcagacgcgtggcgaccaagccgacgcaggcgatggccgctatcgccaaaaccaggatgaggttgagtcttttgttgtcgcgcccatcgcgcgcacctttgcgcttgaccatcatggctcctagtcctgcaagatcttgaacgtcgagccgtcgctcttggtggcgcgatcgtccatatcgactaaaacgccgtcttcaaagcgctcatcgctttcgatgagctccatggcgcggtcgtggccgagcaaaaaatgctgggccgtacgaaagaccttggtagagttgtagctcttacccagaatcagcctattgagatccaccgtcatctccttttatccatcgcacccatagcaataaagagggccgcaagcgaccctctccattgcattatgcaatcaaatactgtgttttacatccagccatcgatgaacggtagcttaggcgctgtacttgtttgcctcgccgaaggtgccagcctcgacaatccagccgtccttcatgatgacgtccatgttgtcggtattgagcacgtggatgtcggcggcgacgtcaccgttgacgaccagcaggtcggcgcacttgccggcctcgatggaaccggtctcgtcctcgatgtggcacatcttggcaccgttgagggtggcgcaggtgatggtctcgaccggggtgaagccgatcttgtcgacgaactcgtacatctcctcgatggagcagttgccgtacggggtgacgaaggagaaggagtcggagccgatcgtcatgacgacgccgcgtttcttggcctcgcgcaggcagtcgtagttgcgctgcagctccttctcgaccagggtgccctcgtacttgtcgtgcagctcggggacgtagacgggcggataggtggagtaccaggtgggcaggaatgcgatcgtcggggtgaagaaggtgccctgctcggccatgaggtccatggtgcgctcatcgatatcgaagccgtggatcagctgctcgcaaccaaagcggacggaatcgtaggcagcggcgtggttgttgtagcagtggctccacaccgggatgccgaccatcttggcctcttcgaccacggcccggatctcctcggagcagtagtgctggtcgcgaccggagtcccagcgccagataccgccaccggtagcccagatcttgatggcatcggggttctcgcgaacaaacttgatatcaagcattagatcctccggcgatatacattccatttaggttgcaaccttgtacatgtatgggcaagtatatacttatgagcgtttacgacccaactcaactacgcaagaaggcacccaatggacgcagttttttcctttttgtttggcacccgcaccggtttnnnnnnnnnntgggattccttgttgagctcctgggtgcagtggtgggagtcgccgtggccggcaacgcggcagaagccaaggccggtggccagaacgcgcgggcccttgaagacgcccttgtcgatgcagtcgcgaatctggatgccaaagcggccgatctcgcagacggtggtgaggccgtgggtgaggcagtcataggcctgcttgacggcgacggcctgcttctcgaggagcggctgcatgacccagtcggtgtcatcgtcggtcaggttgcccgagaagtgcaggtgggtgtcgatcaggccgggaaggacggtcttgccggcagcgtcgatgacctcaacgccctcgggaaggtcctgcatgacgccggcatactcgatcttgccgttgtcgtcgacgagaacgagggagttctcgactggctcggcaccggtaccgtcgatgagcttaccgccaacgattgcatacttagtggacatggttcctccttatggatccatatagtgggcgaggccgtgttgggttaaggcctcacaaagctacccaagtggtgccgggttcggtgcgcggaagagagggccccgcgcacctgatccgccccggctaggcgttactttttgcgggaattggtgaaggccatgagagccagaccgatgaccagccagccgatcacgatgctccactccaccatgttgagggaggcgggagagaacgggatcacgagcaggccgatgatgatggcgcaggcagcgatagcgagacagatgccaaacttgccgccgggcacctcgtagggacgaggcaggtcgggctcggtgaagcgcatgcgcaggcaagcgagggcgaccataccgcaggagaagatgaaggcgagagccgacacgttggtcagagggatgagcatgttcttgcccaggaacggaccgacgacggtgatgacgcccaggacgacgcaggcgagcttgggagcgccggagttgggatcgacctcggcgaacttctcgggcagctgacccttgcggcccatggcgaacatgatgcggctcgtggcgccgtagaaggagttcatggggcccatgggtccaagcgtggcgatgacgagcatggccaggtacaggagcatgttgatgcccttgaggcaggcgagcgcgggaaccgggctcttaacgaactcatgccagtcgaggatggtgccgaacgagtagatacagaccatgtagaagccgccggcggccagcagggccagggagatgatcttgccgaacttgttccagttgaggccctcggccgcttcctcagcctgctgaggaatggtgtcgaagccggcgtagaagaacggggtcagaaccaggaccgacacgatgccggcgaacaggctggcgccctcggtagcggccttgccgccgccagcaccagtgacctgagagaacacgggcatggcgttgtccggcgaaccagtgaacagcgagacgcccatggcgagcagcatgccgcagagcagggccttggtcaggaaggcctggagcttggcggccgagctggcaccgcggaagttgaggaagatgacgtagactgcaaagccgagcgcgatcagcgtcgggaacaggtagacgtcggcgcccaggatggtgtagagcttgacggcgcgcagccactcaagaccgggcaggctgccgaacatctcggacacgagcgtcgagatggcgatggcctcccacgggcacaggatgccgttgcccagggcaaggagccaaccggtgatgtagctcagcgtacggccaaagctacggtccacgtactcgacgatgccacccgagatggggatagcagccgtgagctcaccgaaaacggctccgacgggcacgaggaagattgcacccaagaggaatgcgatcatagcgggaacgggaccgccgcccacgaccatccagtcgccgacctgcagaacccagccagttccgatgatggcaccgaaaccgatggtaaagaagttccagagcgagagcgttttcttcataccaccgttatcctcgactgcaacttctgcgttcttgtccgccattgttcccctcctttcctttttgacgccccttggcgtcaccccttgcgcagcctgtctagcagcgcgcttttatttcgtggctttacaatacggccttggcaccgcgctgccgctcatggctcgaccgaaggcaaaaccgaaaaacgagcggcgccgtttttgggacgaacggcacggtttgccgctcattgttgtcgcccgtccgacgggcgtacgctcatcggacgcatataaagatgtttttgaggccgtgtgttttgcgcctttcgtaccgtttaccgagcttttgacgcgcagacccatttgttgcacatcttttttgtaggatggacaggttatacatgagacaaggcggtacgaatggcatacggatacaacgacggtgatcaacggcgacaaagcgttcgccttgctggccgtaccacgccgacgcccagaagtgccacgagcagcaatccgcaacgtcctcaagagcaacccaggccttcgtctcggcagcagtcaaacagaacgcggcagannnnnnnnnnnnnnnnnnnnnnnnnnnnnnnnnnnnnnnnnnnnnnnnnnnnnnnnnnnnnnnnnnnnnnnnnnnttgggcgcgcgcactcgacagcgtcaggccgaggttccgcaactgcgccgcaacggcgcacgtcagcccggcatccatatcaaccgcttcttttcgcatccccaagacggacgcgacggcaagccctaccgctcgacatcgcacgcgaatgccaccgccctgccggctcgtcgacttcgcctcgcactgtgctctatccttacctgtctggtctttgtgcttatgagctcctgtatgtcccacgggtcggccggtctcgagcccaccgccgaggacaagctgctcaaggcccccgtcgcacccggttattctttcgccttttcgaccccacgctcgcaatggcaagccggcacgatgccccatatctatcagatcgaccctgcgtggtcggagctgccttacgccggcggcaccatccgccaaaatgcctgcgggcctacgtgcctcaccatggtctacatctttaagacgggacgcaccaatatgacccccgtcgatatgtgcgcgctttccgaggcgggcaattacgcccccaccggcgcaatgggctttgacctgtttacgcagatgctgggccaggccgtggctgaggcgcgcggcgatgacgacgccggcgtggaggcggcgagcgtgggtattaacctgccggccgactacttcttgtccgaggagtacctgccggcggtggatcagcgcgtgctcgtgtaccgtaagctcgcagcggccgaggacctagagagcatcgatgaggtgcaggaggagaccgaggctgcgcatggcgagctgccgctggcgggattcaatcgcgcacgaatccgcattcgcggcgagcgcctggggctcgagagcgtcacgctcagtggcggccgcatcacgtttttgggcgttgacgtgcccaagaaggtggcctttgagcttaagacccgctatggcgcggtgaacttccccaagagccgcaagctgtcggtaccctacaaggcaggcgccggtgcgggcagcggcctgggtcgcggtctcgacgccaacgacggcaccggccccgtggccgcggcactcatgctgctgcaacaactgggtgccagcgacgacgactaacgggtcgacgctgcaaacgctccatttgggcaatctgaccctcactcgtcggtcgcgtacgcaagtacgcttccctcctccttcgggccaccttgccacaaatggaacgttttcgctcacttatgctcaacctgtaagggtatttatgggacaaagctatctttgccccaccacgttgcgggtcgacccttcgcccgaccgaaaggaaagcatgttcggatacatctataagaaagatgtcgccattatcgcggttgtcctgtgcctttgtctgggcgtgggcagtttcttcgattatcagatctcgagcgcgctgttcaacgtcggcagcatgtacggccgctttatcgaggccgccggcgagctgccgttcgagctgacggcgagcgtcgcgggcgttatgctcgtacgcgcggtgcgtcccgactccagggggagcaaatggctcgccgtgctgggcgttctgatcaacgttggcctggccggctacgagatcgtttcgtccctgcgggttagcggtaagctcattgccgttcagctggtgctgacgtttgtgctggtcatcgctgccaaccttatcatctatcgcctcacgcgcacgaccgagcccgatgagctcacgcgctgggcgttgatggtgcttgccgtgtgggtcgctcaggccattatcctcaacgtgatcgtcaagccgctgtggtcgcgcccgcgcatgcgcgtgatcgaggtgacgcaggggctcgagtttcagccgtggtgggtgatcggcaatcccgacaagtggacctatatcgccgccggcgtgatcaaggacgggttcaagtcgtttgcgagcggacacacggcgcatgcggcgatcggccttatgctcgccgggcttcccgcggcggcttttaaggaaaaaccttcgcgtcgccgcgtgatcttttgggcggcagctgtggtcgcggcgctcgtcgcgtttggccgcatcgtgatcggcgcacactttttgagcgacgtgagctgcggctttgccctggtgctggcgcttgagtgtctcgccgcgcgcattgcctatcccaacggcgtacaatagctccgtttgaatcatctggccgatacccggtaagagaggattgccatgctcgcgttcaacaacgattattcccacggcgcacacccggcagtgctgcaggcgctcgtcgacaccaatatggagccgcagcccggctacggtaccgatgcgcataccgagcgtgccaagcaacttattcgcgaggcctgccaggcgcctgacgccgacgtgtttttcctggtgggcggcacgcaggctaacgcgacggtgatcgacatgctgcttgcgccgtacgagggcgtcgttgctgccgagactggccacgtcgcttgccacgaggcgggcgccatcgagtttggcggccacaaggtgctcaccatccccggctacgagggcaagatgcacgccgaggacctcgagaactatatccaggtgttctacgaaaacgagagctacgagcacacggnnnnnnnnnnnnnnnnnnnnnnnnnnnnnnnnnnnnnnnncacggtgtttccgggtgccgtgtacgtgagcctatcgaccgagtacggcacgctgtactccaaggccgagctcgcggcgattcacgcagtgtgccagaagcgcgagattccgctgtttgtggatggcgcccgcctggcctatgcgctggcggccgatgagtgcgacattaccctgcccgagctggcgcagctgtgtgacgtgttctacatcggcggcaccaagtgtggtgcgctttgcggcgaggctgtggtgttctgtggcatgcacgccccggcgcatcctattccgcgcattaagcagcacggcgcgctgttggccaagggccgcctgacgggcgtccagtttgaggcgctctttaccgatggcctgtattttgagattggtcgccaggcgattgagaccgctcgggcgctgcgtcgtgtgctgcacgagcgcggctaccagttcttcttggagacgcccacgaaccagcagttcgtgattctgcccaacgaggatatggcccgcattcgcgagcatgcggcgatcgagtactgggaaaagtacgacgatactcatacggtggtgcgcttttgcaccagctgggccacgacgcaggaggatatcgacgcgttggcggctgtcctgtagcctgatgtaatgacaaggggccgccctacgcctgagcttggcgcagggcggcctttgcttttgggggagaagggttgtatgaccgagatgtccgagccgacgattcgcctggcgacgcccgatgatgcgccggagttgcttgccatttacgagccgtatgtgcgcgagacggcgattacctgcgaatacgaggtgccgagcgttgaggagttcgccgggcgcatcgagcgtacgctcaagcgctatccgtatttggtgatggagttggacgggcgtccggtaggctatgcctatgtgagtcagctcaacagccgcgaggcatacgactggtcggtcgagacgtcgatctacctggcacgcgatgtgcgccatggcgggctgggtcgcaaactgcacgacgcgctcaagcaatgcctggtcgcgatgggcatcaccaacnnnnnnnnnnnnnnnnnngctcattgccgtgccgcacgataaggacgacgagtatctgacgcacaacagtcaggatttccatgcccatatgggatatcgcctggtgggcgccttcgaccgctgcgcccaaaagttcggccgctggtacgacatgtgctggatggagctggtcctggctgagcgcacacccaaccaacccaaaccaacctggttccccgacctccccaaacctaccatttagggacaggtttattttggcaggttagccgatgggctcggtgtatttggcgcggtcggtgcgctggatgcgcttggagacgtggagcgggcggccgtcggtgtcgtagacgtagtcggtgatcaggatcagcgcctgcccgcgctcaacgttgagcaaaaacgcctcgttttgcgaggcgtagcacacctcaaaggtcttatgtccctgtgccggcgcgcgatggaactcctgtcgcagcgtggcgtagagcgaaccgttaatatcgcgatcgatgagcgtctcgaagcttggcggcaggtaggtggtctccaggcacagcggcgcgtcgtccaggtagcgcaggcggacaagtttgacgagcttgctgcccacggcggcgtcaaagaacttagctatgctgccggccgccttggcaaagcccgagtccacggtgcgcgtggtgggcttcatgccctggccttcgacctgcttggtatagctcgaaaacaccaggttgttctcgtggagcgcgggcgtgtcggccacaaaggcgccacgcccgcgctcggtgcgcaccaggccctcatcaacgagcaccttaagggcgtggcgcacggtgctgcgcgacagccccgattcgtccatgcgctccatctcggacggcagcttgtctccgcgtgcgtaggtgccggtggcgatgcggtcgcgcagcatgcccgccaagcgctcgtattgggccagtttctttttagatgagacgctcatattgccaacctatatctaacttgtatgcctaactaagcaagcatgtattcaatacaagaacaaaactgctggtaacgaacaatcgaaaaccttaccagcaaaatttctaatgacgattgattcggattacttcgagatcaacggacgatgccacctgaacatcaccaacggcaccgcgattcttgagtgggtggaacgatggctttaataagacgtatcggcttcacccgcttcaaccgctggggcgacaatctggggcggctcacggtgagcgctgcgacgcacaccgacgcgctggacggaaccgacgaactgaacatcacgtgcgccgaagacctcgtgaagggcgaccgcgtagtctggattgaccttcagggcgtgtgccacgagcacatcgttgacaccatcgaccgcgtacacgacgatgacggcgcgccagagacgcaagccgtctgcatcaactcggttaacgagacgtgggatgactggctggacgataagcggccttctggcagcgtgtcggtagccctcacgtccattatcgcagacacgcgctgggaggtcggcacgtgcgatcagggcggcagcgcttcgcgcaccttctaccatgagagcgtgcgcgagggattggccggaatcatcgagacgtggggcggcgagcttgaaacgctcatcgtccacgacggcgcgggcatagttagccgccgcgtgggcgtgcgcgcgaagcgcggaaaccagagcagtgcaaagcggttcacgtggactaaagacctcgtttccgtcaagcgctcggttgcgagcgacaacccgaagacgcgcgtctacggctacggcaagggcgttgagactgagagcggtggctacggtcgccgtctcaccttcggcgatatcaacggcggcaaagactacgtggaggatgccgaagcaacagccgtctgggggcaccctgacggcgagggcggcattcttcccgccgtcgcgtcatacgtcaacgagcagtgcgaggatgcggcgcagctcttgcaggaaacgaaagactacttggagcaagtgaaggagccgaaagtaacctacaccgcttcggttatcgacctatacgccttcgggcgctcgtgggagggcgtgggcgttggcgatgacgttgcgatcatcgacaagggcttttctgccgagggcgtgcgccttcannnnnnnnnnnnnnnnnnnnnnnnnnnnnnnnnnnnnnnnnnnnnngaccgttacgttcggcactcttactgacaacatggccgacatgtggcagagcgtgagcaacgcgttaaagagcaacagccagcaaaacgcaatctatgacgctgcggcgggcacgtcggtttcgtggcttcagcagcttcaggccgcgctaaacgctcagttcaacgccgttggaacctataaggtcgagacattcgagcttggcacgatgtggagcaatgtacccatcgacgctgaaacaggtttgccggtcaaagcgacttcgggcatgtgggctgtcaacattaacggtatgggcatgcgacttgccgcgaacctcacttctgacggtcaatgggactggcgaaccttcctgacaggcgctatggtgagcgccgacgcgatcaacacgggaaccatgagagccgagcgcgtgcgtgccggtcttctgaccgacgagaagggcaaaaaccgctgggatttgacaagcggcgagttctcgctttccgcaagcaccgaggttggcggcaagaccgttcagaaaatcgccgacgatgcggcaagctcagccgtcgatgctcagacgcaacgcgacatattcaacaagctgaccaacaacgggcagacacagggaatctaccttagcggtggtctgctctacatcaatgccaactacattgaaacgggcatcatcagcgacagatacggtcgcagcacgtggaacctcaacaccggttcgcttacgacaaactacatgacggcaaacaatatcgacgctaacggtacgttcgaatgcggttctgcttcaaacctcattcgtcttgccagtggcgagattaaaggctacgaagacggaacgcagatcgggactatcgacttctcagcgcacatgcgaaacgttagcaccggacagctaacgaccggtcttcagttgacgggaaaccagcatatacgaatcaccacgccgcttatttccgccgctgcatctagcagtgagagcaccacgacaacgcatgcgattacgaaagattgcacgttgcattacatcagcaagattcaggatgacggcgacggcacgattacatggtggaacgcaacgcgaagcatcgactttgtagacggcttctgcacggtatgcaacttcgactaggaggaacgatgagcaagaccctttatcacatgctgcacgacccgataggcaactgcgaagcgatggtgaccgaatacgacgaagagcttatggaatactacgaccgcagctacctgctnnnnnnnnnngacgaagagcttatcaaccgcgccgcgagcaacggaatgattttcattgcagttgatgaagacggaaaccgaaccgtcgtgcagccggaagacgtgaaggagccaatcaacgacgatcagcccttcacgctcgttcagcccttgtacgtcgatgaccgaatgagggcggttgtcgatgtgttcgacgctttggctgcgagcgtgccagccgtcgccgcgagcgcggacgtgcagcccgtgtctagcaaggcgcgatctgctatgannnnnnnnnnnnnnnnnnnnnnnnnnnnnnnnnnnnnnnnnnnnnnnnnnnnnnnnacacacggacgcttgaactcgatatctcgaaggagggcgcgggaacctgcatcaaggttggtcagggcgacgatggcggaaccaccatcaaggctcttatctacgacaacggcgctgagttctcgctttccggcgctacggcatggcttgtcgtgcttctgcctaacaagcggaactactatcgcggccagtgctcggtgagcggaaactccgccacgatcacggttgacgaatcgaagctttgcagcgtgtccggctacaccgacgaagcctatttcacgatcacgaagagcggcaagacctattcgacggagcgcttcgcaattgaaatcctgcgcagcgctcttgacgggcagcagcccgcgcagaactgggatgatgccgtgcaagacctcatcgaccgtggagagacggcggtaaagaacgcaaacagcgcggcgagcgcggcgaataccgccgctggcaaggcaaacactgcggcgagcacagccaacagcgccgcgacgaacgcgaacaacgcggcagatgccgccaacaccgccgcatctgccgcaaacacggcgaagcagaacgcggacgctgcgaccacggctgcgaacaacgccgcgtctgccgccaacacggcgaagcagaacgccgacgctgcgaccgcaagcgccaacgccgccgcgagcgcggcgaacaccgctgccgcgagcgcgaacgccgctgctgagactgcaaacggcgcggcagaggatgccaccgccgccgcgcagaacgcgtttaacatcgcaaactctatcgcggctatcgaaccgccgtcagatgacgaggtgcaagagctgcgcgaagagaatgcgacgcttgcgcatgcggttactgagcttcaggacgattacctatacctcggcgaaacgctctacgtgccttcaagcagggtcacggctcaatctggcgagagcatcacgctttctcagtcgagcgtttcgggagagactgcgacactcaactaaggaggttctttcatggctgacatttccgttctcaacgtcggcggctcggctaagaacatcaaggacacttcggcgcgcaactcggcaaacgccgtcacgaccgnnnnnnnnnnnnnnnnnnnnnnnnnnnnnnnnnnnnnnnnnnnnnnnnnnnnnnntcaacgcttacgcggggcgctcgctcgcttcggtcttcgctaacgagatcggcgacaccgacatttacacgtggcttcgcaaccgcgcgcgaaacgccaacttcgccggtcttcgtatcggcgactacatcgacgttcccgtttccgagggcgctaacgtgcccgcgcagacggtgcgttaccgcatcggcgctatcgaccagtattaccagtgcgacgacaccgcgaaggggcaccatatcgtcatggtgccgaaagcgccagtctccgtgacgggcgacaaggcttctaacacgagctaccttcagtggcgcgagacgaacgacaacaacggcaccgccgaagagaagcacccttacttgtgctcgaagctccacgattgggagatcaacgatttcttgcccgctctgccgtgggcaacctcatgacgagcgaggacggctttgcagttgccgataaggcgaacacccagaagggcatcgtcggacaggcgacgcaggtgggcttcaccaatatctatagcgttgagtccacgaaggtggagaacgcctttaaggtccaaaagaagatctccggacgcaactggacgacgtcggatgcctttaccatgacgctgaccgcccagggcgaggcacccatgcccaagggcgcccaggacggtgtgtcgacgattgcgctgagcaaggacgttcaggtcggcaacttcggcactatcgagtacaccaagcccggcacctatacctatgtgattgccgagcaggcgggtgacgagacggcgctcacgttctcgaaggccacctatcgcgccaccgtcacggtgaccgacaatggcaccggcaagctgactgccaagaccaagattgcacagctgaccgacgatgccggtaatactgccgagcgcacggtcgaggcggcggtctttaccaacaccgctaagaccggcagcctcaccgttaagaagacggtcgtcggcggcgacggccagcgcgagttcggcttcacggtcgcgctgaccgacggggacggcgagcccgtctccggcaccttcggcaagggcgacggcgccgtgacgttcacggacggcagagcgaccttcacgcttaagcacggcggggagaagaccatcaccggcctgcccgtgggcgcaagctacaccgtgactgaggatgcggccgagggctacacgaccacggccgagggggccaagggcaccgtgaccgaggccggcgcgaccgtcgcgttcaccaacacgtacggaacggccaccgagggcagggacgtctccaccgcggggctcttcaccaagacgctcaagggccgcgactgggcggagggcgacagcttccagttcacgctcacgggcgaggacgacgcccccatgcccgagggctctgtcgacggctccaagaccgtcagcgtgacggccgccgccggcaccgaggcgggcactaaggtcgccttcgacttcggctctatacgctacacgcttaacgacatcaaggacgccggattcgcggaggtcggcggcaagcgcgtgcgtgccaagaccttcacctacacggtgcgcgaggccaagcccgatgacggctcggcgattgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcggcggcgacttcgtcaacacctacacgaccgagctcgactactcggcccgcgcgggcgtgcgcctgtccaagacgctctccggccgcgccatggaggcggggcagttcgccttcaccgtgaccgccgacgacgagacggccgccaagctcggcctcaagaccggcaagaatgcctacgccgtggccgcggccgatgatggagaggccgccgtggtcgacctcatcggcggcgccgcgaagggcgacgtgacattcaccgatgccgacgcgggcaagacctacagcttcaccgtcgccgagaccaaacttggcggcgacggctacaccaacgacaccgagccgcgcacggtgaccatcgcgctcgcctacgacgccacgacgggcgaactcacggtcacgaccacggtcgtcaaggacggtgtcgaggtcgctcgcagcgaggtctcgacggccgatgacactgcgtcgctaccagcgcccgtgacggtggcgttccagaactcctacgaggccaccggcacgctcggcggcgagggcagcgtggccatcgatgccaccaagacgctgacgggccgcgccgtccgcgatgcgcacggtaacgtggtcgcgaccgcgtccaaccgggcctccggcgacggcgaggtcgcggagcttgcgttctcgcccatctcctacaccaccgacgagctcgagcagatggtggtggacggcaccgccaccagggccgacgacggctcctggaccatcccttataccgtttccgaggacacggcagcgctgcccgccggcgtgacggcgaccgcctcgagcttcgacatcacggtcaaggcgaccgataacggcaagggcggtctggatgtggccgtggcctaccccgagggctccgacggcaagctgtcgttcgtgaacggctacggtaccaacgaggcgacggtcgaccttgcgggcaccaagacgctggcgctcggtcaggccggactcggcctgacgcaggccggcatcgagggcaagtacaccttcaagattgagccgctggacggcgcgcccgcaccggccgacgcctccggcaagacggtgaccgaggcggtcaacgatgccgccggcaacgtcgagctgggcagcgtcacgttcaggcagccgagcgacctcgatgacgtcgagatcgacggcgacggcctgcgcaccaagacgttcgcctaccgggtgagcgagtccggctcggttgatggcgtgaccaacgacgcggtggcgtccaggaccttcacggtcaaggtggtcgaggacaccaacacgggcacgctcgccgcgaaggtcctgcccgccgagggcacgcccgagggcaagggtgcgttcgagttcaccaacacctacggcgttgacccggcaccgagctccgtcaccgaccagatcaaggtgaacaagaagctcaagggccgcgacctggccgagggcgagttcgagttccagctgatcgagatttccgccgacggcagcgagagcgtcgcggcgatgggcaagaacgccgcagacggcacggtggcgctcggcccggtcacctacaccgcgcccggcacgcacagctacgagctgcgcgaggtcgccggcacggcgggcggcgtgacctacgacagggcggcgtaccgcgtgcgcacgacggtcaccgatgctggggacggcacgctcaccgtcaagcacgagctcacggatgccgagggcaaccccacgggcgatgactcagtgacgttcaccaacggctacaaggccgcgcccgtcaccctcaagctgggcgccgccaaggtgctcaagggcgccgagcttaaggcggggcagtttagctttgagctcaagggccgggacggtaaggtcatgtcgaccgccaagaacgccgccgacggcagcgtcacgttcggcgcgctgaccttcaagcaggccggcacctacaccttcacggtgagcgaggtcgacgacggccaggcgcacgtgacctacgacaaggccgtgcgcaagatcgtcgtcacggtgagcgacgaggcggcagacggctccaagacgggctacctgtcggcgaaggtctcctacgagggcgacgccgacgtgccgccggtcttcaccaacagctatgccgaggagcccgagacccccggcacccccgagaaccccggcacgccgggcggcggctccggcgacggctccaagggcggcatgcccgacaccggcgaccgcagcctgccggtcgaggcgctcgcggccatggccggcatcggcgcgctggccgtcgcgggcggcgcggccctgtaccgcaggcgccgctagcggtatgcacgagtggggcgaatccatccgatgagttcgccccacttgccctgctgggcgggagcgggtatgatataccgagcgcctagcgcgttcgatgggttcggatgacgacatgttccgaatctggtcaggtccggaaggaagcagccataaggagcctctgtcgggcatccgaatccatcgagcgcacgggcgctttttggtgccgcgacatggtccgggaggcggcgaggtatttggtgtctcgctggtcctcggctttgcctgcgggatcgctcgactaccaaatacctcgccgcctcccggaccccgtcgtccaaaaatcacccgtagaggcgcatttatctgaataatttaatcccgtgctttgtttgtcggggcttccgtacacacgggagcccctttccttaccggcgggaggtccgcatgagtctctccgagctctggtcgctctatggccagaactatatcgacgcgctgctagcaacctggggcatgacgcttgagtcgtttgccatcgccatggtgctggccgtcgccgtcaccgtgatgcgcgtgtcgccgctcaagccgctgcgcgtctttggcgacctgtatgtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggctccgagaactttatgagcggcatcaacaccgtgggcgtgggccaggtcgaggctgcccgctcgctcggcatgaacttcaaccgcatcctcgccaagatcgtgattccgcaggcgctgcgctcgagtgtgctgcccatgaccaacctctttatcgccgtcatgctcaccaccgccctgggtagccaggtgccgttgcagccgcaggaactcaccggcgtggtaagctacatcaacacgcgctcgctcggtggcgtcgccgcgttctttatctcggccctcggctacctgggcacggcttttgtggtgagccacattggcaactacatcgataagaaggtgagaatcctccgatgagcaagcactcctcccctgcgctcaccatgcgcgatgcgctctacgaggctcccggccccaagatgcgcgccaagattcgtatcggcactgccatctcgctcgttgccgttgcggcactcgtcgtcctcgtgctgcagcgtttttacgtgaccggtcagctctcggtccactactggtacttctttacgcacctcaccacctggaagtttttgctcgccggctttgagggcaccgtcaaggtcgcgctcaccgcaggcgccatcgctctggtgctgggtctcgccctcatgctcggccgcacgagcgacatcaagccgctacagctggtctgccgcgtgctcaccgacttcttccgcggcgtgccgagcctgctgttcatctatttcttctttttggtgctaccccagtacaagatcgcgctgccgtcgttctggatgctcacgctgcccgtcgcactcgccgcggccggcgtgctggccgagatcttccgcgccggcgtcaatgccgtgccgcgcggtcaggtcgaggcggctcaggcgctcggcctctccaaggctaaaatcacctttaaaatcgtgctgccccaggcgattcggtttatcatcccatcgttgatttcgcagcttgtggtcgtggttaaggacaccaccgtcgcctacgtggtgagctaccccgacctgatgcagaacgcccgcgtgcttatcaccaactacgatgcgcttgtatcggtctacctggtgattgcgatcatctacatcctcatcaacgtcgccatcaacaaggccgccatctatgtttcgcacaagaccggcgcaaccatcattcgctaagtacccacgtttttaaggcataaggagccgagcatcatggcacagagcactacttctaccgacaagcagccgctgatcgagctcaagcacgtcgacaaacactatggtgacctgcacgtcctcaacgacatcaacctgtcggtcgaccgcggcgaggtcgtcgtcgtgatcggcccctcgggctcgggcaagtcgaccatgtgccgcaccatcaaccgcctggagaccatcgactcaggcgagatcctcatcgaaggccagcccctgccgcaggaaggcaaggaccttgcccgcatgcgcgccgagctgggcatggtgtttcagcagttcaacctgttcgcgcacatgaccgtgctgcagaacgtcatgctgggtccggtcgacgtgctgggcgtgcccaaggacgaggcgcgcgagcgcgccatggacctcctgagccgcgtgggcgtggccgagcaggccgacaaagtgcccgcacagctctcgggcggccagcagcagcgcgtggccatcgcccacgccctgtcgatgaacccgcacgtcatgctctttgacgaggccacctcggcgcttgaccccgagctcgtgcgcgacgtcctgggcgtcatgcgcgacttggcgcgcgacggcatgaccatgatcgtcgtgacgcacgagatgggctttgcgcgccaggtggccgaccgcgtcatatttatggaggacggccgcatcctggaggagggcacgcccgagcacttcttcgataaccccgagaacccgcgctgccgcgagttcctgtccaagattctgcactaggcgcggtgatggacatgacggatatgacgagggcggccgtgtcgcgccgtcactttttgcagctggcgggcgccggtatgcttgcgctgacggggaccgcgcttaccggttgcggcaactccaccagcggcgagggctccgacaaggggtccaagcttgcggccattaagtcgcgtggccatctgaatgccggcgttaagaaggacgttcccggctatggctattacgacaccgccaagggccgctttgagggtatggaagtcgatttgtgctaccagatcgccgctgccgtctttggcgtgagctacaaggaggcccgtgcccaggagcttgtcgagtttaccgatgtaacgcccaagacgcgcggcccgctgatcgataacggccaacttgacgtggtcgcggcgacctataccatcaccgacgagcgcaagaagagctgggatttctcgacgccgtaccgcaccgactacgtgggactcatggtcaagaagcgttcgggctttacctcgattgaggacttggacggcaaggtcattggcgtgagccagggtgccaccacgcagggcctgatcgagcagatgatcaaggacaacggctttagctgtaagcccgagtttagggcctttagcggctatcccatcatcaagagttccctcgacgccggcaatatcgacgtctttgccatggaccgctccacgctggccggctacatgaacgagaccgttgagctgctgcagcccgaggtcaagtttggcgagcagggctacggcgtggcgaccaagaagggctgcgacctttcggccgtggtcgatcaggtgatttgcgatcgcctggccgacggctggctcgaccaagaggtcaagacctggggtcttgtataggcgcatcgtccaaggaaggaatcaaatgctcgaaggattatttgacgccgaccgttggtcgacgacatttcaaaacatggggcccttctgggagggctttggcgtgacgctacaggtggtcgttgccggtctgctgctgtcgctggtgctgggcacgctgctgggcgtgttctccaccacccgttcgcgcgtgctgcgcgccataagccgcgtgtacgtggagttttaccagaacaccccgttgcccgtacaggtgctctttatgtacatggccggtccgcagtttttgcaggccataaccggtgccgaccagccggtgcgcatcgcgccgttcgtgctgggcttcttgggtgtgggcnnnnnnnnnnnnnnnnnnnnnnnnnnnnnnnnnnnnnnnnnnnnnnnnnnnngtatcacgcggcctacatttcggaggtcatccgcactggtatcgaggccgttccgcgcggtcagatggaggcggcccagagccagggcttcacccgtgcgcaggcgtactggtacattgtgctgcctcagacattcaagatcattctgccgccgctgtgtaaccaggcgctcaacctggtcaagaacacgtcggtgctggcgcttgtggccggcggcgaccttatgtaccgttccgacaactttgtgagtctgtacggttacctgcagggatacatcgtctgctgccttatgtacttcatcatctgctttccgctcgccatgctggtgcagtggctcgagcgccgctccaatcggatttatcctctcccagattctctttatgggggaatacgccttcgatccggattacctcacctttgatatcgagggcatcctcatcaatatcatcgcgccgctgatcatcgtgattatcggagacgtgctactggtaggccagctcaagacggccaacgaagcaacctgtgccgatgagtattgtggcgagctcgacctgaccgagaaacacgacaccttcagccacaccgagaccaccgttgtcatgaaagacgacaaggacgactaagcaatccaaccaataccacccggcctttgacgagaaaggaagatcaccatgggactcttgaaagctggattgggagctgccggcggcgtcatggccgaccagtggaaggaatttatctactgcgaatcgatgcctgctgacgtcttggcctgcaagggcagcaaacgtaccggtggccgcagctccaacacgcgcggcgaggacaacgtcatctccaacggctcggtcatcgccgtcaacgacggacaaggcatgctcgtggtgcaaaacggcaagatcatcgaagtcgcgctggagcccggcgagttcgtcttcgacaccggcagcgagccgagcgtctttagcggcaacctgggcgactccatcaaggagaccttcgccaatatcggtagccgctttacctttggcggcgacgcgggcaaggaccagcgcgtctacttcatcaacaccaaggagatcatcggcaacaagtacggcaccgcctcgcccgtgcccttccgcgtggtcgacaacaatattggcctggacgtcgacatctccgtgcgctgcaacggcgaatattcgtaccgcatcaccaaccctctgctgttctacaccaatgtgtgcggcaacgtgaccgatagctacacgcgcgacaagatcgacagccagcttaagtccgagctgctcaccgccctacagcccgcctttgccaagatctcggagatgggcatccgctacagcgccatccccgggcacaccaccgagctcgcccgtgcgctcaacgaggtcctctccgccgactggcgcgacctgcgcggcgtcgagatcgtgagctttggcgtcaactccatcgccgcctcgcaagaagacgagcagatgatcaaggacctgcaaaaggccgcggtcatgcgcgaccccacgatggcggcagccaatatcgccagcgcccagagcgacgcgatgcgcgcggcagcggccaaccccaacggcgcgatggccggctttatgggcatgggcatggcaggcggcatgggtggcatgaacgccagccagctgttcgccgccggccaggcgcagcaacaggccgcaccgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgccccgagtgcggcagccccgcacctgccccgacaccggccaagtggttctgccccaactgcggtagcgaaaacggcggcaagttctgcagcaactgcggaacgcccaggccctagcccctctatctggtaattggcgggggatccgccgcccccgctcctgcttctatgggtttcgttcgattaaggaggacaccatgaagacaacgttcaaaaagtccgtactcgcattcctgacatgcgtcctggcgctcgcctttgccctgacgggctgcagcggtggcggcggcaaggatcccaaggccaacttcgtcggcagttgggagctctcgggaggaaccctggagggcgaagagctgaccgatgagtacatggatatgctcgaggagtggggcctccgcgccatcctgatcctcgatgaggacggcacaggcaacctcgacctgttccttgaggttatcgacctgaaatgggaggctaaggacgccaccaccgcaaccatcaccgccgaaggtgagtcgcaggacatgaagctcgaggacggcaaactcgtcctcaagatggacgatgacaaactcatcttcaccaagtccgacaaggatctgtccggcacggtgaagaaggatcgcgaggctgccgaaaaggaagatgagatcgatgaggccgtcgaagacgacgacgtccagagcgtcgaaatctcccccgccgtcaccgtcgccgatgacgatctgtgcaccatcaccatcaccgagaagttcaaggacgactggggcgacatcggctttgtcatcaacatcaccaacaagagcgacaaggacctgaccttctacgctcccagcggtaagaccaacgtcaacggcaccatgaaggaaccctggttctcggctcacctgatgcccggcaccaacgccaccgaggaattcacgttctcgagcggcgagctcgatagcctcgacgacctggtcaacacgaccatcggcatcgacgcctacctgaccgattcctacgaggacgtcgcctcctacagcgcaaccatcgcgtaacggcatgtaacatcagccgcggattggcggacacatccgcgcacaccagacggggccgcaggagttaatcctgcggccccgtcgcttttatgccgatgcgtaccgagcgttagcgctccatgttgggaacaatgctgccctccgttaccgcgtgcacggccaggcgcatgatgttgtcgtagccggtcttgttgagaatctccgagatgcggcgcttgatggtgccctcgctcataaacaactcggccgcggtctcgcgacggctcttgccttcgcaggcaaggcgcaaaatcgacaactcaacgtcgtcgagcgccgccgtgcccgaaaagatgctttcgggcggcttgggaaacgtgcaatagcccgccagcgtggagcgcatcacggcaaagagctcatcgatgccgacgttcttgtacacaaagctgtcgacgcctgcctcgcgcgcctgatccacaaacgtaatctcgggcatgcccgtcatgataatgacgcggcactcgggcagctgctctttgatgcgcgccgccgccacgatgccgttggaatcgtgctnnnnnnnnnnnnnnnnnnnnnnnnnnnnnnnnnnnnnnnnnnnnnnnnnnnnnnnnnnnnnnnnnnnnnnnnnnnnnnnttgagcgcgacgtccaaggcatctgaggcatcggcgatggcggcaacaacggtcatgtcgggctggtccccaacggagcgcgcgaggctctcgcgcaggatggcctggtcttcgacgataaggatacgaatcatgagcttctcctttggaccgttgcgttggagttcagcggaatggacaccgcaagcgtaaagggcggggcggcatggacctccaggctgccgcccagattttgcgcgacacgcctcataccaggaatacccgttccctcgcgatacgatacgggagcaggcgcgccgtcatttgataccgtcatgtgggcaatggcaccgccatccgacccctcctgccacaagcgcacatggacccgatgcgcctgcgcatgcttggtggcgttggtcgaggcctcgcggataatctgcgaaaaggcggcggcgacacgcgcgtcctcaggcagcgcaccctcaacatcgatctgcacgctcaccaggccaaaagcatggacgatatcgcccagttgctctgccggttcggtgtcgcccccgctgcgcagatcggcagcgattgagcgcagcagcgggtcgatctgctcgagcgactcgtcgtccaagcgcccctcctccaaatagcgatgaaggattgataggcgctggccgatcacatcgtgaacgcgggcgcgcatgcgcagataggccgcattgtcggcaacttttttgacttcttcgatctgggcctggagctcttggcccgcaagctcaagcaggtggttggcttgcgccaaacgatcgtgagcatgcgcgtactctgttacatccaaaccgataagccgccgttacccggcgcaatgtagagcttgccggcgcgcggtgatgctgcgagcttagctgccaaagcatgctcacggccgccgctgcccaacaacaggatgtcgatggtttgagtgtccgccttcaagggtgcctcctctatggatgaatggcccgctccgcgcgagccctttgcaagcaaatatacccctcggccgcccgtccgggctgcaaaggggtatatcgcaataaccaaatagtcccgattacttccagaatcggttgatgatctgctcgcgaccagcgccaacgccaataaacgtcacgcgggtgtgtgccagatcctcgataaacgccacgtagtcctgagcctcttgcggcaactcgtcaaagctgcggcaaccggtgatgtcgcacttccagccgggaagctcctcgtagatgggcttggcatgctcaaagcgcacctgatgctcgggcacgctggtgtagcgctctccatcgnnnnnnnnnnnnnnnnnnnnnnnnnnnnnnnnnnnnnnnnnnnnnnnnnnnnnccttgatggtgtcgaaggccgaaagcacgtcgagcttggtcacggcgatgtcggtgaggccgttgacgcgcgaggcatagttggcgatagggccgtcaaaccagccgcaacgacgacggcgaccggtggtcacgccgtactcatagccctcctcggtcagcgtgtggccggcctcggactcataggaaagctcggtgggcatggggcccgaaccgacgcgggtgatataggccttcatgacgcccagcacgcggtcgacgttcttcatgcccacgccggagccgatgatggcgccgccggcggtgcagttggaagacgtcacgtacggataggtgccgtggtcgatgtcgagcagcgtcgcctgggcgccctcaaacagcaggtccttgccctcatcgatcatgttgttgagcagcaggctcgtctcggtgatgtaggggcgcaggcgctcggccatgggcaggtactcgtcgcaaatctggtccacggtgtaggtgggcaggttgtagatgagctcgagctcagggttcacgcgggcgagagcggtctccagcttgtcgcggaacagtgcctcgtccagcatgtcctgcatgcgcagaccaatgcgggccatcttgtcctgatagcacggaccgataccgcgcttggtggtaccgatgttcttcttgccgagcttctgctcaaaggcaccatccagatcgatgtggtacggcatgatgacatgcgcattgccgctaatcttgaggttcttggtggtgatgccgtcggcctcgaacatgtcgatctcctcaaggacaaccttgggattgacgacgcagccgttaccgatcaccgacacgtggtcggaatgatgccggagggcacctggtgcaggccgtacttcttgccgttgacgacgatggtgtggccggcgttgttgcctcccgagtagcgcacgacggcatcgaagtcgccggcgaccaggtcgcagatcttacccttgccctcatcgccccactgggcaccgaccaaaacggttgacggcatgtttactccttacattcatggactgtctacgcgccacgccggcacgcagaagcacaaaacattcccagtatacccgtgcaacgggcgcctgtcctactcctcggcatgtgccccatcaagctcatagaacttggtggatgccggcaggaacatcaggtcgacgtcgccgatcgggcccgaacggttcttggccacgacgatacgcgtaacgccctcgtcgggtcgatcgtcgcgcgaggcttcggcctcgtcggcggagcggtccaagaacataacgatatcggcgtcctgctcgatggagcccgattcacgaaggtcggaaagctgcgggcgcttgccggtacgggattcgacctgacgcgagagctgcgacagcgcgatgagcgggatcttgagctccttggccatgatcttcagaccacgcgacatctcggagacctcgacggtacggctctcggagcggcgtcccggcggaggactcaccagctgcaggtagtccaggatgatgatggccttctccttgttgtggagcatgcggcggctcttggcgcgaatctcggtcaccgtggtgccgggcgtatcgtcaatcagaatatcgagcttggacaaggtctgcgtggcctcgttgatattggcccactgctcggggctaatgcggcccatgcggaagtcactgatcgagatcatggcgtaggcgcaaatcagacgctgggcaatttccttgcccgacatctccagagagaagaagccgacggtataaccggcagcggcggcgttgagcgccagattcagggcgaacgacgtcttacccacagcagggcgggcgccgataatgatgagctgaccctcgcgaaaacccatgagcatgcggtcgagcgacgggaagcccgtgggcacgcccgcagcctggccaccggcctggcacacttcctcggcctcgttataggcctcgaccataaactcggtcagcgtcttatagctcgacttgacctcgcgtgccgtgaccttgagcagcttgctctcggctagctccacgacctctttggtgtcggtgggggcgttatatgccagcgcgttgatctcgttggtggcgccgatcagctcacgcagcatcgaatcacggcgaacgatggcggcatggtgctgccagttgacgagcgacagagtctgacccatcaactccaaaatgtacgcttcgccgcccacggcatcgagcttgttgatgcttcgcaggtaatcgatcagcgagatggagtcgataggaatgcggctgttgtacatatcgaccatcgcggtatagatggtcttatgaatgggccggtagaagtcatcgggctgcagctcgacctgggcctcttcgaccacctcgggcgatagcagcatagcggccagtacattggcctctgcatcttggttttggggaagacccaactttgagccgcggtcctcaaccgtcagcccggtctccctatcgtcatatgccatgagcatcctcattcatatcgcttgcgagcatccatagtatcagccacggtcccaaaacgcgccgcgcgccgccaatcatcaccgaaccaagcggatgaacgatcctgtatataggacttcgacgcaacgttcaccatgacactcactcagcgcaaaaaaacaaaagggcgccctggtttcccagagtgcccttcttagaacaagattgttgcgttgcagcaaatgctactcggcagcagcctcagtctcgacctcggcggtctcggcctcggcgacctcagcggcctcctcgacctcagcctcggcagcgagctcctcggcggtaacgccgacgagaacgacaacctcggccttgatctcgcggtacagcgagatggcaacggtgtgggcaccggcaaccttgatgggcttaccgagttcgacgcgcttgcggtcgatgtccataccgagctgagccttgatggcgtcagcgatcatggcggcggtaacggagccaaagaggatgccctcgtcgccgaccttgacgtcaacggtgaccgtcttgccctcaagggcagccttggtctcgttggcggtagccagacggacggcctcgcgcttggcgatgttgttgcgacgctcgtcaagctgcttgaggttgcccttggtagcggcaacagcgagcttcttggggaacaggaagttctcagcgtaaccctgagcgacctctacgacgtcaccctcgccgcccttgcccttgatttcatcgagaagaataaccttcatgatgcgtctcccttcttagccgcggtcgcggttgccacgagaggaaaccacggggacggtgtacggcaggagagccatctctaatgcaatttattagatgaatatcttagtactaacgacgcagatgtaaaccatctgccgccaatcggcagctctcactgggcaaactggctgcggtagagctcggcgtagaagccgcctgccgctagcagctcgtcgtgcgtgccacgctcgataatctgcccgccgcgcatcactaggatgcagtcggcatttcggatcgtcgacaggcggtgcgccacgacaaagctcgtgcggccggccatgagctcgtcgaatgccgcctgcacctgcagctcggtannnnnnnnnnnnnnnnnnnnnnnnnnnnnnnnntatcgatgctcgacgtggcctcgtccagcagcagaatcgccgggtcggtgagcatgacgcgcgcgatgcacagcagctgtttttgaccctggctaaacgtgccgccgtcctcgccaatcaccgtgtcgtagccgcctggcagctgcacgataaacttgtgtgcgtgcgcgcgcttggcggcctcgataatctgctcgcgcgtggcgtcggggcaaccgtaggcaatgttctgggccaccgtgccctcgaacagccacgtgtcctgcagcaccatgccaaaggcgcggcgcaggctctcacgcgtgtagtcgcgcgaggaatgcccatcgaccacgatgcgcccggcatcgatatcgtaaaagcgcagcagcaggttgataagtgtcgtcttgccgcagcccgtgggaccgaccagggcaaagcgcatgccgggcttggcgtcgatgcagatgttctgcagcagcttgcgatcgggcacgtagctaaagtccacatgctcaaaggcgacctcgcccttcggagcggcgagctcaatggcatccacggcgtcgggctcctgctcgcgggcatcgagcagcgcgaacatacggcgcgctgaggcataggccgtctggatttgcgtaatgacgttggtgacctcgttgaacggcttggtgtactggttagcgtaggacaggaagatctgcacgccgcccaccgtgagcgccgcgggcacgcccgtgatcacgcccacgcagccgatcacggcgaccacagcgtagatgatgttgttgataaagcgcgtgccggggttagagagcgaacccataaactgcgcgcgctcgcccgccgtgtagagctcggcgttgagggcatcgaagcgctgctgcgcgttcgggccataggcgaaagcgtccacgagctttnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttggagagcttggcgatggcgccggccgcaaagatggaaagcggcgtgacaagcaccaccacgagcgtcatggtcaggttgatggacagcataaacgcaagcgtgcccacgatggtgatgatgccggtaaagagctgcgtgaagccctgcagcaggccgtcgcccacctggtcgacatcgttgaccacacggctcatgaggtcgccgtgggcatggctgtcgataaagctgagcggcatgcggctgagcttgtcgctcgcctccacgcgcatgtcgcgcaccgtctcgtaggacaggcggttgacgcagtagccctgcagccactggaacgccgcagcgccaaccacgaccagcgcaagcttggtgacaagcggcaacagcgcatcgaagtccacctgcccggcggcaacgatgaggtcgatgccttcgccgatgaggatgggcgtgtagagctgcaagatcaccgagatggcagcgctcacaaacgacgccgcaaacgaaatgcggtgcggacgcacgtagcccatcaggcgacgggttaccgcgcccacgggatagcgctcggggtcgccgggctggcgcgggccatcgcccaggtcgttaaggttatcgttgccggacacattggccgtcattgtggcgaccgaaccggaagaagtatacggattcatctagcagccctcctttgcgcaggtggatgcaggggcagtcggggcggacgcgggacttggggcggacgcgggcgccgcgctcccttgctggccctcaagctcctcgcggcggagctgcgactggcagatttcgcggtagagctggcagcttgcgtacagctcgtcatgcgtgcccaggcccgcgaccgagccgtggtcgagcacgcagatcatgtcggcatcgcgcacagtcgagacgcgctggctcacgatgacggtcgtcagcggcagcccgccctcggcggcgccgcgcacgctgcgctcgcgaatggcatggcgaagggccgcgtcggtcttaaagtcgagcgccgaggcggagtcgtccataatcaggatctgcggcgagcccaccagggcacgcgcaatagtcaggcgctggcgctgaccgccgctgaagttcttgccgcccgcttcgaccggggcatccaggccctgcggcttgttgcgcacgaactcgctggcctgcgccatatcgagtgccgcccagagctcctcgtcggtcgcggactcgtcgcgccaggtcaggttgctgcgaatcgtgccgctcacgagcgacgcgcgctgcggaacggtcgcgaccacatggcgcagctggtcgagcggccaagagcgcacgtcggtacccatcacgcttacgctgccgacgcccgcgtcgtacaggcgtggaatgagcgagacgagcgtcgacttgccgctgcccgtgccgccgatgatgccaagcgttttgcccagcggcagctccagggtcacatcattaacggcgttggcagcgcccgcgccaaaggagaagctcgcgtggctcaagctcagcgcggggaccaaagcggtgtcgcccatcgcactcggctcgggcagagcgaccggctcgttgccctcgtcggtaatgctcggcgcgcagttgagcacctcgttgatacgcgacgcgctggcgctcgccttggtaaagaccacgaccaggttggcgacgtacacgatggaggtgagggtctgcgtcatgtagttcacaaacgccatgacctggccctgcgtgagctcgcccacgttgacctggatgccgcccacccacaggatggcgcacacgcccaggttcatcacgagaaacgtgacagggttgagaatcgaggagagcttgcccaccgcgatggcaacatgcgcctggtcatcggcggcttgggcaaagcgctcgcgctcgtggtcctcgcgcacgaaggcgcgaaccacgcgagcgcccgaaagcccctcgcggcaaatgagcgcaatgcggtcgagctttgcctgcagctgcttgtagtacggaatgcagcgcgccatgacaaaccaaaacaccaggccgatggcgggcgtgcagatcaaaaagatgatgccgagcttaaggtcgatggcaagggccgcgcacatagagcccaccgccaagaagggccagcggatgagcatgcgcacgcccagcgccacggcaagctgcacctggttgacatcgttggtgatgcgggtgatgagcgacggcgtgccaaagcgatcgagctcagcatagctcagcttattgatgtgcccgtagagcgcgccgcggatgtcggtacccatgccctgcgaggtgagcgccgccatcttttggcagacgagcgtaaatgagatgccgatcacggccatggcaccaagcaacatgccgtagtggacgacggcgttgacgtcgtgcgcgccgatacccttgtcgatcatctgcgcaatcacgagcggcgtcagcaggtcaaagatcacttcgatcagcttgcacgcaggaccaatcaccatataccggcgaaaggcacagattgcccaggacaacccggcggcgcttgccgacccgcaggcagttgcgcgcgctctgtcgctcgagggcggaacccgccgcgtgagcctgactcgtgccacgcctgatggcacggtcatctactactacgcgctctttggcctggtcgcgatgatgtctgccgagtttgccgccttgagcgtcgtcgacttgcagcccaatctgtcgggccttggtgcccgccgttgtgtgggcggcctctccaagacggcgtcgctggccggcatttttgtcggctcgtggctggtttcctttgcatcgatggcggttgcgatcggctacgtgcgcctggtcgtgggcgtcgactttggcgggcgcgaggggttgtgcctgctgggcggggctgcatccgcgcttgcggcgacgggcctggggctctttgtgggcacgctgcccgttaagggcggcaaggcgtccaagtcgggcatcctcacgggcttcgccaccacgtgtgccctgttcgccggcctttacggcgagccggcgatggcgcttgccgacgacgtcgcccgcgcctgcccggccgagtgctggctcaatcccgtcaagctcatctgtgacatgttcaaccgcctgtatttctttgaggacctgggtccctttgccgtgcgcgccggcgcgcttgtcctgatggccctggtgtttgtcgccgcagccacgctgatctttggaaggagccgctatgagcacctttaagactgcgcttcgcatggcgctggcgcacccgttctacctgctcatctatacggtgttcatttcgctcatgggcgtattcatcgcggcttcggtgagctggaactcgtcgcggcttaccgagtacaagccctacgacaccaacgtgatcgtggtcgaccgcgacaatagcgacctttcgcgggcgcttaccaagcacctgggctcacgctttgacctggtcacgggcatcggcgacgacgcgtacgaccttgcggacgcgctcgccaagagcaacagcgccaagggcagtgccgattgcgtgttctttatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggcgcttgaacccgctgcctccaacggtgacgtcgcaagggccgccgagcacgcggccgcaaagcgcgcggaggtccagatcgagcaggtcaaggtcgattcgactgccgccgccacgctcgagtcgtatttcaactttggcgcgtacgcgatcatctcgtcggtcatcgtgtcggtggggctggtgttctcgggcatgaacgagcccgagcgcgtgcgccgcatggatgccggcccggtctctgagcgccagcgctcgctcgctgtgtttgccgccgccgcggtgctcaccgtctgcatctggtttgtgtcgagcatgatgggcgtcgtgggctttgccggcgcggttgccgaggtcggcgtgggccgcgtgtgccttgcgctggcggcaacgtttaccctagcgtgcacgcccctggccgttggctttacgctgtcgagcctgggtgcgcgcgaggagctgctcaacggcgtgggcaacctgcttggtatgctcatgacgtttttgggcggcgcctggatgccgctgtcgctcatgggctcggccgtgcagaccgtggcgcgctttgtgccgacatattgggtgaacgacnnnnnnnnnntgcgcgcaggatgatctgcgtgttctcgtcggtggagcgggtggggtcggtgtcgtcgatgcgcaggatgaacgtgccgccgtttgcacgggcgaaagcccagttatagatagcggtacgggcgccgccgatgtgcagcttgcccgtcggtgagggtgcaaagcggacgcgaacgtctgatgccatggaaatctcctcgattgcaggatggatgtctaaccgcatcagtataaagcatcaaagcagcctccgcacaaagggcaccgacctactcattggggacagacttaaatgactagttatcggggacagtctttgccgattcgccgcctcgccggctgggttggcaaggactgtccccaactgccggcaggaaaggaacgtccctaactgccggatagcgaaagagtgtccctagtgactagtcgtttaagaacgtccccaatgactagtttgaaataaatgtcatatgtcacacaaaaatagttcgcctgggtttactataaccctagaaaagtagcagaaggctaacaatgggggatagtatggcgacgaagcaagcctacgtccaggttaaggacctcaagaaacactacggcgacggcgatgcacgcctgacggtgcttgacggcatcgacacatccatcaaccgcggcgagatctgcgtcatgctggggccctcgggttcgggcaagtcgacgttcctcaatctcatcggtggcctggaggacgccgacggcggctccattatggtggacggctgcgacctgacgacgctcaagcccgccgacctgggcgagtaccgccgccgcgagctgggctttgtcttccagttctacaacttggtgcccgacctcaccatcaaggaaaacatcgaggtcacggcgcacctgtccaaaaacccgctcaacgtcgatgacctgctgcgctcgctgggcctctacgagcaccgcaacaagtttccgcgccaggtctcgggcggtcagcagcagcgctgcgccatcggccgtgcgctcgtcaaaaatccgggcttgctgctgtgcgacgagcccacgggcgcgctcgattacaagacatccaaggagatcctgcagctcatggaggacgtcaaccgtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtgcagatgaacagcgagccgggaatcacggtgtccacggcatcgcccgccgcggccgccgagctcgattggtaggcggcgccatgtcacctctcgcaaaacgactcccccgcgagctgcgccgcaatatcggaaagtacctgggaatcttcctgcttatgtgcggaagtatcgccctcacgtcgggctttttgcttgcggcccattccatcggctgcctcatcgacggcatgcgcgacgagtacacaatcgaggacggtcgcctgaccacggcgttcgaggccaccgacgaccagctcaaagccgccgagaatgcggccagcgacaccggcggcgtcacgctctacaagaacttctccatcgacgccatcatcaaaaaggcgtccggcgacgacggcaccaagcgcaccctgcgcacctatgctcaccgtaccaaggtcgatatcgcgtcctactgcgaaggcaagcagccccgcgcggacgacgaggtggccatcgaccgcgtcttcgccaccaacaacgatctcgccgtgggcgataaggtcgagctcgagggccgcacctacaccatctgcggcatcatgacgcagcccgatagccaggcgctgttcctcaacaactccgactttacggtgaacaccatcacctatggcgtggccgaggtcaccgacgccggatttgccgcgctcgaggacgccggcggcgcgcccacctacacctactcctttacctttaacgaccgcgacctctccaccttactccgcttatcacccatgattccgacggcgctgcactggcggcgcctgttgatgctgcccgtcgtaacggcgccgagtacaagatgcgcacaatcgaagacctgcgcattaaggacgatcgtctgcgcgctgccatcgaaggcacggggcacctgctgtttgacggcggcatgggcaccatgttgcaggctgccggcatgaaggcgggcgccttgcccgagctcctcaactttgaggagccccaggttatcaccgatatccagcgtcagtacgtcgaggcgggctgcgacgtgatcaccgccaatacttttggcgccaacgcccacaagctcgacggcgccgccaccgtggccgacgtctttgccgcggctgtcacctgcgcccgcgaggccggcgcccgctacgtcgccggcgatatcggnnnnnnnnnnnnnnnnnnnnccctcagctttgacgaggcctacgacctctttgccgaggaggtgcgcgccggcgtcgctgcgggtgtcgacctctttattatcgagaccatgaccgacctggccgagatcaaggcggcagtcctcgcctgccgcgagaactccgacctgcccgtctttgccaccatgacttttgaagaagacggccgcaccttcttgggcacgagccccgaggtcgccgccatcaccctcgacgccatcggcgccgatgtcttgggcatcaactgcagccagggtccggccgagctccgcgggctcgccgcgcgcatgctcaccgtcaccgacaagcccgtcatggtgcaggccaacgcgggactgccccgcgtggacgacgacggcaacaccatctttgacatccaggcacccgaatacgccgaggccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgagtgcccagacggttgtggaccttccctgcgatggccacaaaatcgccgtgatcggcgagcgtatcaaccccaccggcaaaaagcgtctgcagcaggccctgcgcgacggcgacctggattacgtcgtgagccagggcatcagccagcaggagcagggcgccgacatcttggacgtcaacgtgggcctgcccgagatcgacgaggtcaaggtcatccagcaagcgaccgagcagctccaaggttccacgctgctgccgctgcaaatcgactccaccgaccccgccgccgtcgaagccgccgtgccgctacgcaggcaagcccatcatcaactcggtcaacggcaaacagcagatcatggacgagatcttcccgctggtcgctcactacggcaccaacgtcgtcggcctcacgctcgacgagggcggcatccccgataccgccgaggcccgctttgccatcgccgagcgcatcgtggccgaggccgcccgctacggcatcggcccggaccgcatccttatcgactgcctggtcatgaccgcctcgaccaaccagcgtcaggccgagcagatcctgcgcgccatgtcgctgtgcaaggagcgtctgggcgtcaagtgcgcgctcggcgtgtcgaacatcagctttggcttgcccgcccgcccgctgcttggctcggtctttttggccgccgcctttggcgctggcctggacgcccccatcatgnnnnnnnnnnccaagcgctttatggacaccgtctacagctatcgcgtgttgagcgtcgaggacgagggctcgaccggatacatcgagcgctacgccggttggaccgacccgtacaaaatcgccgcgaacccggcagcggctcaggcagcatcgagcgatgccgcacccgccccgggcaccgccgccagcgccgacgacgaccccatccgccacatggtcgtctcgggccgcaagggcgagatcgcggccgagaccgagcgcctgttggccgaccacgacgccatggacctcatcaacaaccactttattcctgccctcgacgaggtcggcgtcctctttgaccagggcaagttcttcttgccgcagctcatggcctctgccgaggccgcgcgcgtgggcttcgataccatcaagcgtctgatgcccgccggcgagattgccgacaagggcaaaatctgcgtggctaccgtcaagggcgacatccacgatattggcaagaacatcgtcaagatgctgctcgacaactacggctacaccgtctttgacctgggccgcgatgtcgatccgcaggaggtgctcaagaccgtaaaggagcgcgacattaagctcgtcggtctctcggcacttatgaccaccacggtcgtcgccatggaggagaccatcaagttgcttcatgccgaggttccgggcgtcaagatcatcgtgggcggcgccgtgctcacccccgaatacgccaagcagattggcgcggactactatgccaaggacgccgccgagagcgcgcgtatcgccgaagaggtctttggccggtaacacaacggaaacaaccccgcaccaaaacgtgccgcatgtgccactcggcgcgtgcggcacgttagaatagaggggactatgctcgttttggcagataggagcgcaaggatggcgatcacgcctgcagaaatcgcggaaacccgcggcatggttgaggagcagaacctcgacatcaggaccatcaccatgggtgtttcgctcatgggttgcggtgacgagaacctcgaccgcatgtgcacgaagatctacgaccacgtgacgcacacagctgagcacttggtcgagaccgccgagaacctcgagcgcgagtacggtatccccatcgtcaataagcgcgtttccgtcaccccggtggcgcaaatcgccgcttgttgcaaggatgaggacctcacccccatcgcgcatgccctcgaccgtgcggccgagaccctcggtatcgactacctgggcggcttctccgcgctcgtccagaagggcatcggcgacgccgaccgccgcgttatccagtccattccgcaggcgctcgccaccacgagccgcgtctgctccagcgtcaacgtcgccagcctgcgtgccggcatcaacatggacgccgtgctcatggccgcacagaccatcatcgacgccgccaagctcacggccgaccaggactccgtcggcgcctctaagtttgtatgctttgccaatatggtcgaggactccccgtttatggcgggcgccgtccacggcggtggcgaggccgacgccgtcatcaacgttggcgtctcgggccccggcgttatggccgcggcactggagacgctccccgactccgcctcaatgatggaggtcgccgagaagattaagcagaccgcctttaagatcacccgtgccggcgagctcatgagccgcgaggccgcccatcgcctgggtgtcgagaagggtatcgtcgatctgtcgctggcccccacgcccgccatcggtgactccgttgcccgcattctcgagatcatcggtgttggcacctgcggtggcccgggcacgacctgcgcgctcgccatgctcaacgatgccgtcaagaagggcggcgtcatggccagctccagcgtcggtggcctctcgggcgcctttatccccgtgtccgaggacgccggcatgatcgccgccgtcgaggccggcgcgctctcgctcgagaagctcgaggccatgacctgcgtgtgctccgtcggcctggacatgatcgccatccccggcgacaccccggtcgagaccatcgccggcacatctcatttattctatggccgagctctgtataccttgtgggatatagacgtctcaacccttcgtttcattgcggattagacgccgagatacagcatagccgtataccgttcgcggttccagacggtaaaccccctgtaaactcttgacctgcgggtttatattggtttagagggggtgtaactccgtgaacggtctttaatcccgaataaactaggtaaaaattgcatacgggtgaatgatggtcttgtcaacacgaggcgtgatgttcgagcgcctcatagtaatagtcggcaagaccggcggaaaggaaatcgacatggcactgcctaaggatttcatcgacaccaacgacttcaccaaagagcagatcctggctatcgaggatcttggcctggcaatgaagaaggccatcaaggttgacggttattatccgcacctgctccgcaacaagagccttggcatgatcttccagcaggtctccacccgcactcgtctttccttcgagaccgctatgaccgacctcggcggccatgctcagttctatggccctggcaccatccagctcggcggtcacgagtccctgggcgacaccgctcgcgttatgggctcgctgctcgacatcatgatggctcgcgttgaccgtcacaaggacgtcgtcggcctcgccgagggctccgctgtgcccgtcatcaacggcatgtccgagttcaaccatcccacgcaggagatgggcgacctcatgaccatgctcgagaacctccccgagggcaagaagatcgaggactgcaccctggccttcatcggcgacgccacccaggtctgcgtctccctcatgttcatcgcctccaaggtcggcatgaagtttgtccagtttggacctaagggccaccagatccccgacggcggcctgcacgttggcaccgtcgaggagcgcgccgagttcggcaagcagatgatggccatcgccgaggagaactgcaaggtctccggcggctcggttgtcatctccgacgacatcgagtgcatcaagggcgccgacttcatctacaccgacgtgtggtatggcctgtacgacgaggaggtctcgggcgagaactacatggacgtgttctatcccaagtatcaggtcaccatggacatgatgaactttgccggccccaactccaagttcatgcactgcctgccggccacccgcaacgaggaggtcgtcgacgaagtcatggacgatcccgagcgctccctgtgctgggtcgaggccgagaaccgcaagcactccatccgtgctctccttgccgcgacgagggtgtcgagtactccgccaaggctgagctccacgccgctctcgaggctctcgagcagctctaagcctcaaggcttttaaaagcacgtttgcgggcggcggatgctcgtctcctgtcgcccgctcaccgaggcccaagcaattgccttaataccttagggcctcggatctgtccaagactgagcgaaggagctcatcatgagcgacggaaagaaaaagctttccttcttgacggtcatttcgaccatcatctgcgtcgtcttcgtttgcgaggccgccgctcctgctgctgctattggcaaccagcagttcttctggtggatcttcctcatcattacgtttttgcttccctatggcctggtggtggccgagctcggtacggcgttcgattccgagggcggcctgtacgattgggttcgcctgggcttgggcgaccgttggggcgcccgctgctcctggtgctattgggtcaactttccactgtgggtggcaacgctggccaccatgttccccgatattctgggcatggtctttggcgtcgagttcaacctgattgccaagatgggtatcgaacttgcctttgtgtggatcgtctaccttatgggccgctccaaggctgccgactccgagtgggtcctcaacggtggcgccattatcaaggtcgccgttgccgttatcgtcggcgccctgggcatctggtatgccatggagaacggttttgcgaacgacatgtccgctgccaccttcctgcccgagctcaccaacaccaacgctcttggctacctgtccatcatcatctttaacttcatgggcttcgaggtcatctgcaccatgaccgacgacatggccgatcccgctcgcgatattcccaaggctatcatcgtcggtggcctgtccatcgccgtgatctacctgttcgccggcttcggcatcggcgccgccgtgccggccgactccatcgaccccgactacggcatgatcgtcgcagtccagaccatggtgggcgactccatgatcttcaaggtcatctgcatcgccttcctgatcaccctgttcgccaacatggccgcctggtccttcggcgtcaactccgtcgcccgctacgctgccgagcacggcaacatgcccaaggtcttcgcctcgatgatctcggatgacgacatgcccaacggcgccaacctggtcaacgccgtcgttgcctccctggttctctgcctgcagctggtgcccatcgacgccatctccaacggtgtcttctggatgctcttcggcacctccgtcgtcttcctgctgctgacctacatcccgatgttcccggcgttcctcaaccttcgcaagaacgaccccgaccgcgagcgcatcttcacgttcccgttcaagggcgccatgatgaaggtcatgctggccatcccctgcatcgagctggtcctggccatcgtcgcaactctggttccgttctccgccgctgaaattggcgacaagctcccgatgatcgtcatcttcatcgtgctcgtgctcatcggcgaggtcgtccgcgtcgtcagcgccaagggccgcaaggaagagtacaagggtctgacccctgagctcgcagcccagcgtctcgctgaggaggccgccgaggccgaggagaactagagcacccggattcggggctccaaccctcatcatcttctaaccattccctggggtgggtgtgagcgatagctccggtaaccaccgcccaccccaatctctcttccgtatccttcgtgcgttttgtctccacgcacttggttacgtcgtcgcttgccggtgcgactccgtgaaaaccggcgccaggcgccccgacctttgctggggaacgggcgcctaccatctcttggttttaggctgcaggtaacccgcccgcagcaaacgatcgttcgatttggaggaaatcttatgcgtacgatcaccgagtccgagtccacccccagggccgacggcttcttcatgcccgccgagttcgccccgcaggatcgcgtgtggatgggctggccccaccgcaccgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttcaacgcctacggcggcctcgtcgacggcctctatttcccgtgggacaaggacgagcagatcgcccttaagatggctgagctctccggctgccgtcgctatcgtcccgatgacatgatcctcgagggcggctccatcaccgtcgacggcgagggcacccttgtcgtgaccgaccagtgcctgctttccccgggccgcacctgctctgcggttctggaggaggaagaggatcccgagtccatctggcccaagtaccacaagaagtttgagtgcactgagtgttcggtcgagggcacgtcctcggcaatggcggaggcgctcgaccgctgcctggcgtgcgccgtctatgcgcatccgctgccgcgcatcattaaagcgtacaaggatgcgggcgagcgacgtctggctccgtatctggcggagctgctctacgacaccgccctgcatgcccaggtcgtagcgcccgatcgctacggaggcgtgctgtccggtgcggatgcggtggtgtttgtgcctgcgacggcggcagcgtttcggcggcgtggttttgatcatatggaggctattgcgcgcccattttgcgagctgtcgggtgttcctctgctcgatgctctcgtcaagtacgggcatggcgaccagcgcgaactcggtcgtgaggagcgccgcgagcgtgcccaaggcatgtacgagacggttgaggacgtgcacggccgccacctgctgcttatcgatgacgttatcaccacgggtgcgacgatggcagcggcttcggcggaactcaagcgcgccggtgccacggccgttgatggcctcgctatcgcacgcgtttggtaggggtggttttgtggcagtaaagattgagcggcgcaacgagccgacaggcgaacagctagcggcttccataattctgaccggcgcctcggcgctgcgcatgatgcgcgccgnnnnnnnnnnnnnnnnnnnnnnnnnnnnnnnnnnnnnnnnnnnnnnnnnnnnnnnnnnnnnnnnnccttaatcccgatgaagagcgccgtgtgctgcgcacatcgtcgccctcgaccgaggacatctatcttcccgatttggtgcggattggggccgcaagcggcgaggtgcaagaggatttgtgcttgctggtagggtctgcagcgcagcgccgccgtattcttggcgtgagctggtccgtatgctccgagttgcccgccggctcgattctagaggtggaaccgggggtgtacagtctatctcccgaggccctttgcgtagccgtcgcgcgcgaggtcggctgcatccaggcatttgccctggcccaggagctgtgttctaagatttcactgagtgaccgcgggaagtatctgcctccctacacctcgcctgtcgtgaacaaattggcaaaggacaaagaccagccgccagatgtcggttactttgaggtcgagtccgtgnnnnnnnnnnnnnnnnnnnnnnnnnnnnnnnnnnnnnnnnnnnttacctcgcggcatgcaaggggagcgcggccaagcagctgcggcggctgtgtccctatctgtcggaaaacctgcgttcacccatggagtgcatcatgcttgccatgttttcgcttccgttttcctatggcggatttgcctgtggtccctttaagaccgactacaagatcgagttcaacgaccgtgcacaggcgatctcggggatgccgcatgcggtttgcgatgcctttcaggaagcagcccggtttgacttggaatacaacggtgagctgggccattcctctcggaggggacgtatccatgatgaaaagcgcaacacgggcttgattactatgggaatcgaggtcgcgacggtcaacaacgaaatgctctgtgacatggaagcgatggaagcactcgcatggcgcatccaccagcgtatgggtaagcgatatcagaatcgcgtagaggctcgtcgaaagaggcaagatgctctgctgaatacgctccgagcgtgctttgggctcaaaccagcgtaaaactatggctttatagggggtctgtttatatgctctgtgcaaaaaacggcaaatatgagtactgttacaattttagtagcaggcaaaaccatccaaaatggcgtccgagcgacccctgccaaggtcgcgcgcgcagacgtggtgtaagagtgtcctgaggtccgtcgctgcaagtcccgatgttactccttcttgagaccgcgcttctcgactatctcgtccactatctccctggcgcgccgcccgagcgcgcggcgcctcccctctgtcgaggccggcctgtccgcgggctcggcgaagccctcggcggccgaggcctcggagaacacgcgctgctgggaccactgcccctcggtctccatgaggctcgcgcacgtcaggcgcagcatcgactccctcgaggggaaggactgcacgaccctgtagcggcgcttgatctcgcggttggcgcgctcctggacgttgttggtgcggagcttggcccagtgcgccctggggaaggccgtgaacgccagcgcggagtcctcggcctgctcgaagacctcgccggccctggcggacaccgacgccacccagggcgccgcctcggcccacacgcagcgcgcgaggtcggggtcgtcctggtagaccgcggcgtgcacgaggtccctgacggccgccttggagtcctcgggcctgcccgagcaggcgctctggaggttgcgctgcaggtgcgtcacgcagcgctgccaggcgcagccctggaacaggcgcgagacggcggccacgagcccggcgtggctgtcggagaccacgaggcgaacgccggccagcccgcgctcgcgcagcccgccgaggaatgccgcccaggagtcctcgctctcggtgtcgaccacgtcgcagcccaggaagtgcttgcgcccgtcggcgcccagcccgatcgcggtcacgacgccctgcgagacgaccgacgagccgaccctgcagctcatgtaggtggcgtcgagccacaggtagcagcacggcgtgcccgaaaggtcgcggcggcggaactcctccacctcggcgtcgaggtcggagcagaggctcgagacctccgagctcgacagcgaggatatgcccagcttggacgccacgcgctcgaccttgcgggtggacacgccgcacacgtacatctcctgcacgatggaggccaccgaggtgtcgacgcgcgaccatcgcgcgagcatgccctcggggtagtaggtgccgtgcctgagcttgggtatctcgagctccacgtcgcccacggcggtcttgagcgacctggggcggtagccgttgcggctgttctccctgccgtcgctgcgctcgttgcggctcgcgccgcacatctgctgggcctcggagtccatcagcgcgttcatcacgccgcccagcaccctgcacgcgaactcgcgcgcgtcgccgcactcctgccaaagcctcgccgcctcgagggcctcgtcgcggccgaggcgcagtacactctcttcttggggcatcgcctttccttccattcgtcaccttcattactccaacgacgaattctaggcggtgtcccctccctttcaagaaagagaagaggcggggcatgccccgcctcttacaccacatctctgcgcgctaccgtcgaaatggcgatgaatgcacgattttgatccagctgttagtccttataatggacatatgttgcgtaacttaagcaaatactatctttttatacgttgtaagcaaggtagcagtactcatttttgccattttttggccacgacctttgtgacagacgtgctggcgggttcgaatcccatgaaataggcccaaacaaaaaacggtcccctttcgaggaccgtttccaaatcagtggtgggcgatgagggatgtccgcgtgcggctggcgccgcccgcgccccgctctaaacccgaaaaatcatcgtgactaaacccgcaacaactaattgaacacaaacaatcaggctgatttgtgctgtcaggctggctggcgtcagcggttgatctgccgatgttgctgctcgtcagtctggactgttgggctttcgttttgacagcggaaggaagatcctcctcgcggtagggcaacaattatcagtatcataattaaggtaatcgtgattacattaaccatgatactcttattattgggcagtaggcggatcggagggctgcaatgtttgtcgcacgagagcacgagttacaagtgctggaaaagctgtttaccagcgattcgttcgaaatggtggtgctgtacggtagacggcgtgtagggaaaacggcgttgatcgacgaatttgtcaaagataaacgcgtgctgtacttcacggccatacagcaaagcgccaagatgaatcttgaagatttctcaagagcggcattgtcgttctttggtatgccggattccaccccgtcgtttggcgggtggtctgatgcgttatcgtttgttgctgaacgtgctgcacagactgacgaacgtatggtgttcgtattcgatgagttcccttatgcagctgccgccgagccagcattaccctccatgttgcagatagcaattgaccatggattcctcgccacaaaagtgacgatgattctatccggtagtaacgagggattcatggaaaacgacgtattggggcgtaaaagcccgctatacgggcgtcgtacagcacagattcgactcctgccattcgactatgcggatgcggcaaaatttctaacgaacacatctccgcaagaactggtccaatactatgcgactttcggcggtacgccatattatctggcccgtatacaggaagccgatggctttgaatccaatgtgctgcgcttgatgttcgacaacttgggcgtactgcgtgaggaacctatgatgctgttgcgtcaggagcttcgtgaaccggcatcgtattattcgatattgcaatctattgcgggtggtaattcctcgccaaagcttatcgctgaacatgcgggtgtcggatctgattcgattggagcatatctgaaaacgctggtcgatttgcgcttaattgagcgaaaagtgccgtttggtgaagatccgagtaaatcgcgcaagggaatgtatgtggtgagcgatcccttctttgcatattggttccgctttgtggggcgcaacatgagcattttggatggtaatatcagcgaggaggttacgagcagactcgcttttggaccagcgtttgatacctatgttggtcaacaatttgagacgatttgcctgcaatggcttattcgaaacaacgctatgggcaacctcccctttgttgccactcagttcggcaaatggtggggcaatgatccgattgctcacgagcaaaccgatatcgatgtgattgctgcggattcgctcgataaaacgattctgttcggtgaatgcaaatggcgtaattcattcaacgaaacggaggctattgaaaagctccatcagcgtgctggcttagtccgcggctatcaggcaggtaatgcgtggcttatgctgttcaccaagaatccggtgagtgagtccacgcgaacccgctacatggatgatgaacgaatggtgttcgtttccgcggaagagttatacactgcgtgatgcattactgggtgattgtgacgcggtatctagagtcctgccgacaaccacgtggcaattacgccgaatcacgcaccaccaaatcggtgttcaggtgcatcacgcgcggtgaagagactccgttgatggctttgatgaccacgtcggccatggtccagcgcgctgatccatgtgctgatcgacggtggtgagttccggggttatggaggtggaagctaagttgttatcgggcttacgtatttggggatagcacttgttgctcgttgtacatatagcaatgcccttgcctcctcacgggaagcaagggcattacgctactgcttagtactgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggccagggagccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtccccgttgtctaaatgaaagtgcaacacccgttagattggaaattgcctagaaaaccaggctcccccatcgccgccgacggcacgatctatcaaattccgtgcacgagcgccacgctcaccctcgacgatgtcttcgccacgggcgaaacgatcaatctggccgaactcgccgagcaagactcgatactcaccttccgccccatcggcgccgtcgatatgaccaacaacgagatctacgacgccgcattgcttgccatggcatacaaaggcaacgacgcgcccgatgtggcggccctgtgctaggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaagggctaatcagtccttatttcaccgcaactgaaacaggggcgccctcttatagagagcgccccgttcgcattccaatgttgttggcatgaggccggctgtgagccacctcgtcttaggccaggaactccttggtggtcgccacgatgttggcggcgtccaggccatacttgtgcaagagctcggcacccgggccagactcaccgaaggtgtcgttgacgccgatcttcttgagcggtgtcgggcactgctcgcacaggacgtcggcaacggcgctgcccaggccaccgatcacagagtgctcctcgacggtcacgacggcgcgcgtggcaccggcggcctcaatcacggcctcggcgtcgagcggcttgacgcagtacatgtcgagtaccgttgccgagatgccctgctcggccagcaggtcggcagcgtccacggcatggcggaccatctcgccggtagcgacgagcgttacatcggtgccgcggcgtacccaggtggcgcgatccatctggaacgggcactcgtcctcggtgtacacgtcctcgaccgggttgcggcccacgcggatgtaggccggtttgttatcggcgaccagggcccgcacgagctcggcggtctggaagcggtcgctcggcagatacacgcgcatgttgggaatcgcgctcatggcggcgatatcctgcgcggagtgatggctcatgcccaaagcgccgtaggacacgccgcccgagatgccgatgagcttgacgttggtgttggagtacgaaacgtcgaccttgcactgctcatacgaacgcgtggtcacaaaggacgccggcgaggcggcccaggccttcttgccgcacgaggccataccggcggcgatgctcaccaggtcctgctcggcgatgccgacctcaatggactgctggggatactggtcaaagaacggcgtgagcgatgcagagccgcgggagtcggaacacaggacgacgatgtccttgtcagttgcggcggcctcgagcagcgtgtcgcagataaccttgcggttggcgatcttgttagccattgatagcctccttatgggcagcgaaatcggcgataatctgggcatattcctcatcgttgggcaggtgatgatgccaggcggccttgtcctccataaccggcgagccgtagcccttcaccgtgttgaggatgatgaccgtgggcttacccttggtctcggcggccagcgtcagcgcggcgtcgatggcctggacgtcgttgcccggaatggacagcacgttccaaccgaaggcggcccagcgctcctcctgcgaatcctgcttcatgacgtcctcggtgctaccgctgatctgcaggcggttgcggtccacgagcgcgcacaggttatcgagctggtagttgccgccgctcatggcgccctcccagaccgagccctcggcaagctcgccgtcgcccatgatggtgtagacgcgatagtcgcggccgtccatcttgccggcgagcgccatgcccacggccacgggcaggccgtgacccagcgagcccgagttcatctcgatgcccttgagcttgttgttggggtggccgatgtaggggctgccgaacttggagaagcgggccttgacgtcgtcgaggtcaagatagccctcgtggcagagcaccgcgtagtaagcctccatggcgtggcccttagagagcacgaagcggtcgcggttgggatcgtcgacggtctcgggcgaaatgttgaggtggttggcatagagggtcatgagggcgtcaatcaccgacatgtcgccgccgatgtggccgccggcgccagccatgatgatatcgacgcaatcgcggcgaaggtcccaacgcagggactcaagctcttcgatagttgccatttctactctcctcgcaggtaggctttgacgtcttcttcaatcgggtcgtataagtcgggggcaatgccgatgtacttgcacgcctcgtagagcaccggcaccacgttggcgtgaatggcgacgcagtggtggatgtagggaccctcgacgatcttggcctcgaggcgcttgaggttgtcgacctcgacccacaggtaggtgcccatgccggccgggccgtcgatgccgcgggcgttgcccagtagcagcgagtactcgccgttgtcaccgtcaaagcgggcaagggtgaggtcgccgtgcttggcctcggccgtcagcgcgccggggtgatcgaaagccagcgggtaggtgagcttgggcttgacggccgcgcagctgcagggccaggggccgcaatgctgcagcagctcgccgttctcgttatcgggatggcgcacggtccagtcggcgaacatgccgcggtgacggcccaggtcggcggcctcgaccatcagcgcggtgatggcgccgtggatatcggtctcgcatacgataggaatgcccatctcgttgaggatggcgttggcggcgcagggcataatgcccagctcgtcctgcagagcgttccagcactgaatggcaccggcgttgcagccatacttctcgaccaagcgcttcatggcgatggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagctcgccctcgttgcacatggtcgaccagaagtcgaatggacgggtggccatctgcaggatgcgggtgtgcttgaaggtcttgaccacgttgcaaacggccaaaaagtcccaaacgccgcgctcgaactcggggtcggtcaggcggcagttggtcatgtaggtgaagggaacctggaagcggcgcaggaccttgccggtggcgaacagaccgcactggctatcgcgcaggcgcgtgccgtcgggctcggggcgctcgtcgcgcgggccccacagcagcacgggcaggccgagctcgcgggcaaggcagtactacgaggatcgtctgggtgagcgctataccggaaccatctcgtgggtcagcagcatgggcctttttgttcgcttggatttgacgcaggtcgagggcctggcctcgattaaaagcctgggcaacgagtggtttgagttcgacgaggacgcgcttacactgacgggcgccgacacggggactcgttatgagctgggccagcgcgtgattatcgaggtctcgcgcgttaataccacgcgtggacacttggactttaagcttatccattagtcgaatcccgaccgtgcggggagcggggcggtccttcggggccgcccttgcatttgaatgatggctgcgtcgccgcctgctcggccgcctatccgcctgctatttgggaggtaaaacctaccaaaataaacctgtccctttttggcaggtttacaagaaagcggggatgagatggcgactgtgtacggctatgcgcgcgtgagctctcgtgatcagaacctgaatcggcagtttgatgcgctgatcgcctatggcgtggagtctgcgaatatttatgccgaccgtgcgagcggcaaggacttcgaccgtccgcaatatcgcgatctgctgcgcgtgctgggggatggggacgtgctggtggtgttgtccatcgatcgcctgggtcgtaactacagcgagatactcgaggaatggcgcctaatcacaaaagagcgcgggacggccatcgtggtgctggatatgccgctgctcgacacgcgcgcaaaggatggagaagcgccggacgtgacgagtacactgattgccgacattgtgctgcagctgttgagctacgtggcgcaggtggagcgcgagaacatccaccagcgtcaggcggagggaattgggttgatttccgatctcagccgaacacattgagcggataggccgttcccgcagttagccgaacgcccccgaggcccctcacgggccccgggggcggcattttcccagttgaaggaacggtggagatgtgtttcgatgggtccggtggccatgccccgccccccgcccggcacctgttcccatactcagccggacggacggcccgcctattccgtttttcccttcaggctaggacagcggggcatcgcccctctctgctcgcgcccgccctatcagccccggcgtcaggtcgagctcgccgagcggcacgtcctccacgccgtaggcgtccagcagcgccgccgcgtcgtcaccgagcatcgccctgaaggcgcgggcgggcgtcgcgaagccgagcgcgccgcggggctcggagttcacgtgcgacatcgcgagcgccaggtcggccggggagagccggtcgaacctgaggccggcgcccttgggcagcagcttccttatctcgacgtggttgcgctcgcaggcgcccttctggtcgctgcgcctggggtcgcagtagaacagcctcgtctcgccgggcccctcgccgaggagggccgcgaccgcgccctcgtcggcgaactcggcgccgttgtcggtgagcacggcgcggaacacgcggcgcgtcccgtcggcgccgaggaccgcccggacgccctccagggcggccgcgacgcacccggcggtcttctcttccaacagcagcgcgagctgcagcctgctggggcggtgcagcagcgtgagcaggcacgcggagtcctcccgggagccctcgacggtgtccatctcccaggccgcggcgcacgcgtcctccccgagggcgaggaacgcggcgtacgacctgcgggcggagtggcgcgtggccgcccgggaggcggagcgcttcctcggcctgtagccgacctttcgcctgagctccatgttggtcatgccgtcgtagcccgccgagacccagcggtagatggtcgagggcgacaggtccaccgggccgccgttgcgcgccgccatctgctcgggggagagcccccggcgcaggcagccccttatcgcctccagcctggccgccgcggcgggctcgtcggcgtctatcccgcgcctggacgagacgagcaccgagtccgcgcacagctgcgcggcccgggcctcgtagaagacgtgcgggcggcgcttgcagcccaccgcgcggtagcggccgcagccgtcgcggcagcgcggccacgccgccaggcgcgggcaggccgccgacaggtcggtgccggcgtcgacgcgctcgccgcgcctggccttgggcgccgtgacgaacctgtgcgacgacacctcggcgctcaccgtcgagggcgacctgcccagctccctcgcgatctccctgcacgatgccctgcgctccagcatcctctggaccgtgtcccgctcgtgcctcgtgagcctgccgtaggccctcggggccgcctccgcggaacccttcttcctctttccggacatgccgtcctccgatctcccggggccggccgatccggccctcagggtatcgggttcccatattcatccgtacatgtgcggatgaatgtgggaggtgttcggatgaagttgatattcaagggcccacgcgcgaacaggatttgatttttgaaatatggacgaattcctcgtcaggagggtaaaatgatgccgacggcagcccaagttgtggtgagctgggcagagccgttgcttagtagagttaggtcatcgtcttagcgacggtggcctttctttttgggcttcgaaccctgcttgagtgccttggaaaggccgacaagggccgtgaggagcgagaccatagcggtcaggagcttcacgagctcggtgaaatcggtcatgggcatcacctcccatcaaatggagggctctgcccggcacgagggctgccgacagcaaggacgattctatcagagcggctgactcccgcccgatattaccatcccaccgcgcctgtgcaaaaaagagggccggcacaatgccggcccttcagcgaaattgcatgttagcgcgtatgaatgttagcccgaattaccccgctacttgtcgtcatcgtccatggagccgtcgatgccggttttggtgtcgtccgtattggaatcgtcatcctcggggcttataggacacattttgtcctataagccccgatcaattcatactcctcatcctcgccgaattgcgagtatggcagaatcggcactggatggcagcgcgctaggccgtgtccgcggagttagccccttgttttatcgtaacagctgattctagggacgtttcactgtgccccttttggcaatttcctgtgccctttttggaaactcgagcgcctatctgaccgatgggaaagatttagcgaatttaggtgtaccactttgtgttaccagcgcggccagacccaggtgctctccgtcctgtcactcggtatgctcaacgagggccagcgtctggatactattgagcccaccgagggcaagcgctacatgcaccactacaacttcccgccgttctgcaccggcgagaccggccgcatgggcagccccaagcgccgcgagatcggccatggcaacctggccgagcgcgccctgcttccggtgctccccgacgagaacgagttcccttatgccatccgcgtcgtctccgaggtcatggagtccaacggttcctcttcgatggcttcgacctgcggctccacgctcgcccttatggacggcggcgtgcccattaagcgcccggtctccggtatcgccatgggcctgatccaggaggagggcaagaccgtggtcctgtccgacatccagggtctcgaggacttcctgggcgacatggactttaaggtcaccggcaccaccgagggcatcaccgccctgcagatggacaacaaggccaccggccttaccttcgacatcctggcccgcgccctgcagcaggccaaggagggtcgcgccttcatcctgcagaagatgctcgatgtgatccccgagccgcgccacactacgcgcagcaccgctccgcgcatcgtttccatccaggttccgaccgacaagattcgcgacgtcatcggttccggcggcaaggtcattcgcggcatccaggacgagaccggcgcctcggtcgacatccaggaggacggcaccgtctttgtcggcggcaccggcgagtccgtcgaccaggctgtcgagcgcatcaagctcatcatcaaggttcccgagccgggcgaggagtacaccggtcgcgtggtttccatccagcccttcggcgcgttcgtgaatctgctgcccggcaaggacggcctgctgcacatctcccgcgttgccaagggccgcgtggagaaggtcgaggacgtcctcaacgtgggcgacgaggtcaaggtcgtcgtcatcgaggtcgacgatcgcggtaagatctcgctcgatcgccttgacaagcccgaggccccggctcgcgccgagggtgcctccgagggcgacggcgagcacttccagcgccgtgagcgtccgcgtcgcgagcgctccgagcgcagcgaccgtccgcgccgtcccggcgacaacggaggccgcaagccccgccgtcaccacgacgccgagtaacagctaaacataagcagctcaacaagggcgactccggacaggggtcgcccttttgcttgcgcccgggagggccgcatatgaagtttcctgctctacagtcctgcgcaagacggaaagcacattaagtgctctcctttgcgtgcggaactcgcgatgaccttaatatatttctccggccctccgccgtgctcgggagacgacacgttgatgtctgcttaactctgctcgctcaggctaatgactttgttgggggtccactatttgctggagggtgaacttgcattgcattggctcgccctctacttgtggctccgcctcatcaaaatcgaagatcatgatggcgcagttggggagttttgttgggagctcgaagccctctggggctgcagccttgatgaattggcggctggcactgccgtggcttactgctaggagggtttcggtgtccttagcgcccatgagattggtgagggtgcccaccatgcgctcctgcagggcatggcttccttctccgctaaatgggataaggtcctcgccggggtcccagacgtcggtgggaannnnnnnnnngcatcgtgggggccttcttcgaaggtgccgtagctgcgctcgatgatgccttcgcagggctcgactgcggcgtccggaccgaggagttcgcatgcgacgagactcgccgtgtccatggctcggcctaagggtgatgagaccactttgtcggggacgacgccgtgggtcttgagccatgcggctgccattcccgcttgtttgcggcccaggtcggtcaacggagaatcgcagtggccctggaccagctttttaacgttgaattccgtctgaccgtggcggagtagatatagacgcttcatgttctccccttctgtataccttgctttgccggcacagccctgctcgtgggcatggccgacatagtcctcgtcgatcgtaatcttggcgaccgacttgggatattccgattcgacccgttgtgccagcgcgtgccttacgtcttcggcgctcatgtgcagatccgagggacgcacgcagtcaaaaatcacattggtgtgcgtagggcccggcacgcaacgcaaatcgtgaatcgaaaggcggctatcgatctcttgagccatagcgttgatgcataaacgcatgctcgccagcttggggtcatcggtcacgatgggatcgtagtgaagcgtgacgatcatgccgtcttcgttcctaaacgcctgctcgatgttatcgagcgtgtcgtgactttccatcgggctggcctcggctgccatctcggcgtgagcgcttgcgaacttcctgcccgggccgtagtcgtgaaccatcagatcgtgaacgcccaaaacgccggggtagctcatgatcttgctgcggatatgctcgacgagcttaggatcgggcgtctggcccaaaagcgggctcaccgtatcttggataagctcaaagccgctccagccaatataggcgccaacggcaaggccgacccacgcgtcaagattgatgtgcgtcacctgcgaaacaattgcgcacgccagcacggcgcccgtggcaaggacatcgttcttggaatcttgcgcggtcgcatgcagcgtctcggactcaatgcgatcgccgagcttttggttgagggccgccatccagagctttacgaccatcgaaagcactagaactgccaccagggcaagcgagaactcgacgggttcggggtggatgacgcgctcgaccgaggacttcaccagctcaacgccaatcagcagcacgagcgccgccacgaccaatcccgagagatactcatagcgaccgtggccgtaaggatgctcggggtcggccggcttgctcgccagcttaaagcccagcacgctcacgatattcgagctggcatcggacaggttgttcatggcatccgccacaatcgaaaccgatcccgaaaccacaccaattgcgcccttcgcagcacaaagcgcaacattggcgacaatacacaccatgcccgctaacgtgcccacacgcgcacgatcgccctgcgcgcgcctaacaatccactcgaccatctacatccgcccccacggtactaagtagacaaagcggctcgggggcgtgtcgcttccgtcacgttctatcagcatgcaagacggttttggttcttgctcgtgacggaaacggcgcgcttccgagccgctttaaaagaaagggggcgaggtctaggacacgccccctttcacgatagagagctaaccctagccgcggaccttcttgacgacgtccatggcctcgcgggcgatctgctcgaccttggagaagtcgccgtcggcgaacagggccggcttgaccatccaagtgccaccgcaagcgatgatggcggaggagctcaggtactcctcgacgttagcggtgctcacgccgccggtgggcataaagcggtgaccgacaaacggggcggcgagggccttgatggtgttgaggccgccgtacagggctgccgggaagaacttggtgaccttgaggcccaggttgacggcggcggtgacctcggagggggtcacggtgccgggcagcacaggcaggtcgatgtcgatgcagtgcttgacgacgtcctcgttgtagcccggggagacgatgaacttagcgccggcggcacgggcctgctcaacctgctcgacggtcaggacggtgccggcgcccacgcacatctcgggctcggcctcggccatagcggcgatgcactcggcagcgcaagcggtgcggaaggtgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgatcgaacatgatgttcctttcgatgtgcggcgcgcgagtgcgcgtaattgctaaagaagattggccatgagccggttccggattggttatcggaggcactgcttgggtcacaagcaatttcggaaccggctacgaggccagtcgtgaaggaatgccaggcagagccggaatgggactaagtggttctacctggccggagaaatcggggagcgggctgcagaggtatgggtatgggaaactgcagcccgcggaatggggaacgaattaacgggcgacgcgggtgccaccgtcggcggcgttggccacggcagcgatctcgtcggcggtcaccaggttggaatcacccttgatggtgagcttgaggatcgaggccgcgatggcgtagttgacggcatcctgcgggtcgaagtcgttgatgagggcatggacgaggccggcgttgaaagcgtcgccggcggcaacgccctcgagcacgtgcacgtcgtgagcaggggagaaccagtgctcgccgctctcggcgtcatagagcatgcccatccagatggagcgctcgacgcaggagatgttgcggacgaccgaggcgaccttcttgcagccgtactcggcgcagatctgacgggccatctcgacgtaggtgtcgcgctcctcgatgccgtgggcaagggagccggagacgcaggtcataccgaggccggcaggtgcgtcctcgtcgttggcgatgcagatgtcgacgagcggaaggagctccttcatggttgcctgcgacttctcgggcgaccacatcttgccgcggtagttaacgtcgcacacggtggtgatgcccttggcgcggcaagcggtgagagcgtccttgcaggcggcagccatctcgtcggagacggcgggcgtcacgccagagaagtagaagacgtcgatgcccttgaggatctcgtcccagtcaaagacgtcgcgcttggccatgttgatggcggagtacttgcggtcgtagacgcagccgttgccgcgctgcgaggcaccgacctcaaacacataggagccaagacggtcgccctgacgcacgacgcgcgtggtgtcgacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcgccctgataggccagggaaagcgcggtgttggcctcggcgccgccgtagcggacgtcgaactcggtggcctgctcaatacgcaggtgatctttgggcgagagcctcatcatgatctcgccgaaggtaagaaccgttttacccatggtcgcgtagctccttttgtctgtgcgtacacctttgatatggcgttggcacggaggtgccaagacggtagggtgcatctttgcacctccgtgccaacgcttaccgaaatcggtttacgaaatcggtttcgtttcagcttgtagtatactcacctacaacgttttgcaaccgagatttttaaaaaatgcttaaatggctaaggattgccgttaagtgggaaacgaggggcgctatggcgcatatgagaatcaaggacattgctgccgaggcgggcgtgagcccggccaccgtttcgcgctatctcaacaaccgccctgggcagatgaccgaggagactcgcgcccgcatcgccgaggttatcgagcgcaccggctatcgtccccgtgccgccgcgcgcaacctgcgcagctcgcgcaccaacctcatcggcgtgatcctggccgacatcgccaacccgttctcgagcgccatgctcgagggcctttccgccagcgccgccgcacgcggctgctcgcttatgacggccatcagcggcaacgaccctgccaaggagggcgagtcgctcaccaggctcatcgatgcgggcgtggacggcttggtcgtcaacacctgcggcggcaacgacgcggcgatcgccgcggctgcgggtcgcctaccggtcgtgttgctcgaccgcgatgttgccgacggcggtgtcgatctggtgacctccaacaaccgtgagctggtcgccggcctggtagacgccttggcctctgcgggcagcgagcgcctgtgcctgctcaccgaggcaagcgacgacagccccgtgcgtcgcgaacgcgccgaggcgtttgccgatgagctctcgcgccgcggcctggccggcgaggtcgtcaccttggcggacggtggtgtcgagggtgtcagtcgcctggacgagaccatccgcggctatgcgggtaaaaagctcggccttatcgccgtcaacggcctggtcttcttgcgcctgaccgaggcgctggcccagcttggcccctcgctgccggcaggccttaagatcgcgacgttcgatgactatccctggaaccacgtgctctttggcggtgtgaccacagccgcgcaggacactctggcgatcgccgagcgcgtggtcgagcgcctatccgagcgcatatttggaagagacgaccaacaccgtctaccagtgcatgaaagaacaaggtggccatatctcgctcatggtcatccgcgagattgtcgaaaactttatccacgcgcactttgccgagcccatcatctcgattctggacggcggagacaccatccgcttcgctgatcaaggacccggcatcgacgacaaggagcgtgctttcgactttggcgttaccnnnnnnnnnnnnnnnnnnnnnnnnnnnnnnnnnnnnnnnnnnnnnnnnnnnnnnnnnnnnnnnnttaccagcgcaaacagcaagatgaagcgctacatccgtggaaccggagcagggtttcccatggtgcaggagtatttggaaaacgccggcggggccgtgtccatcgaggacaacatgggcaacggcaccgtggttacggtaagcctggaccctaaacgcgtgcaggaaatagagcgtgccggcggacgcggtgctgccgtgcggcccgagacggagcagcccacatatcccctgccgggagcttttgcgcagcagcccatggcaacgcaacagatgcagccccccgtgggacagatgcagcagcccggaatgcttcctacacaagagccccagccgnnnnnnnnnnnnnnnnnnnnnnnnnnnnnnnnnnnnnnnnnnnnnnnnnnnnnnnnnnnnnnnnnnnnnnnnnnnnntggcggatcaggatgcaacagcaatgcagcaggcgacgggggcaccgggtggccagcaaatgggctatcagccgtaccaacagggatatccatatcagcagatgccgccactggggtatggccagcagttcccgcagcagtaccagcagggatatcagcagccgtaccagcagatgccgcagcagcagtacaacccctgggcccagcagatgactccgcagccttaccaacagtggcctcaaagttttcaacagcaaatgccgccgatgcagagttctcaacaaccagcagctcaaatgatgtatcctaannnnnnnnnnnnnnnnnnnnnnnnnnnnnnnnnnnnnnnnnnnnnnntatcctaatgcagcaaatcagtatgcgcagccacaaccggacgtgttcgtaagcgatcgcggcaacgccgcgctgggctatctggcgcaaaatcaagcgtgcggtgctaccgatctggcgagggcgtttggaaactcggcccccacttggtcacgcacgctcaatgacttggcgcaggccggcttggtcatcaagcatggccagaaataccatctgaccgaactcggcgccgctcgcgtgcgagctcagagctaaagaacgggagagacagtggacgaggaagcaagcatcatcctgggggatgccatcgccttttgccagcgcgacggccaagatgcacgcctcatcaacatgctggggcaatcgcgcgccataagcctgaccgaagatacgctcacgatcgaggccccctcgcgctttgccatcgcgcagctcaaaaagcatcagccgactattgaggcctatctggaagaaatcgcctttgcaccgattgcgctcgacatcgtggcaccgcaaggagccgtggcggaatccgctgctgcgacggcgcccgccgcggctcccgctgcctccccggcggtgccggcctccgcaggcgacgtgccgacaatcgagcaccagcacggcgatgtttcccgtgaaaccatggcaccgttgccgaccgcggcggcgacgtcaacgaacgcacccgtcacgcacatgcctatcgctcacgacgcagcggcgggcgcggattcgggcattgcaatcaagaacacgctctcggccgatgattttcgtcgcatgatgaaccagatgaagggcggagcgccgactaagtccacgcaagctgcgacccccgcttcacccatgccggcaccgaccgtaccggccgagcagaatgcggatggagccccgctcgccgcgaactcaaaatttacctttgagaactttgtctacggccccgagaacagccatgcctatcgctcggcactcaagtttgccgcnnnnnnnnnnnnnnnnnnnnnnnnnnnngacgagcgtggcacgtgcacatcactgttcatctacggcaaatcgggcctgggcaagacgcacctgctgcttgccatcaaaaacgagctcgccgagaagtcgcccgagatcaaggtcaagtatgccaactcccaggcatatctggacgacctgatgaccgagttcgaccgccaaaagaagagcaacgcccctatcatgcaggcataccacggcgtggacgtgctcatcatcgatgacatccaaaacatcatcggcaagcgcgcgagcgtggactactttttccagctcatggacgagttcatccgcaacaacaagaaggtcgtcatcgcggcagaccgcgcccccaaggacctgagcatggacgagcgtctgaccagccgcttcaacgccggcatgctctgcttggtcgcagagcccagctacgagatgaaatacaagatcttgcagcgctattacgagaacaccatcgtcgccgctcccgaggcaggcgacgactcgctgctggcggcctatgggggcgacggcgggcacctgaccgacgagcactttaaannnnnnnnnngaggtctcgggcaccaacatccgcgaactcgagagcttctgcgagcgctgcgccggcgaggcgggcgaccgcgagcgcgagggcggggagctcacctttgacgatatcgacgccatcgccagccagtacttcgacacatcggccaaaaagatcaacgtccagacggttcagtccgtcatcgaagagcagtacggcgtgacgcacgaggagctcatcggcccgcgtcgcaacgccaatatcgccaaagcacgccatattgccatctatctggccatcgagatgtgcgagatgacgaccacggcggtgggcgccgaatttggcaaccgcaaccactcgaccgtcagcacgagttacaaaaaggtccagaagatgatccaggaagaccgcaccgtcaccgaagacctcaagtcgctgcgcgataaaattacactgcgctcgtagggaaatagagacacctgttgaaaacttgtcgaaaccacggcaccggtatcggtgccgtatcgccgctcggtaacacggcgcttgctacctgggcggccatgtgcgccggcacgtgcggcatcggcccgatcacgcacttcgataccgatgcgtttgccgttaaggtggcggccgaggtcaagggttttgacggcaacgagtactttggcaagcgtgacgccaagcacctggacccctgcgttcagtttgccctggcagcgtcggacgaggccatgcacgatgcgggctttgatgtcgagggcgccatcgatcgcgagcgcctgggcgtctacgtgggttcgggcgtgggcggcatgcagacactcgtcgacaacgtccacacgattgccgaccgtgggccccgccgcgcatcgccctatatgatcgcgatgatgatccccaatatggcttcgggcaatatcgcaatccgccacaaggcaaagggcccgaccctgcccgtggtgaccgcctgcgcgacctcggcccatgccgtgggcgaggcgttccgcgccatcaagcatggctatgccgatgcgattctcgccggcggcgccgaggccgcaatcatccccgatgccgttgcgggctttacatcctgccgtgctctcaccactaatcctgacccgtcgacggcttgccgtccgttcgatgcagaccgcgacggctttgtgatgggcgagggcgcctgcgtgctggttctcgagagcatggagcatgcgcaggcgcgcggtgcgcacatttatgccgaggtcgtgggctacggcaacaccgatgatgcctatcacatcacgagccccgatcccgaggctgccggcattgcccgtgcgatatcgctggcggtggctgagggcgacgttaagccttccgagggcctctacatcaacgctcacggcacctcgaccaagctcaacgattcgtccgagacggcgggcataaagcgtgcgctcggcgaggacgcggcacgcgccgcgcacgtctcgtcgaccaagtcgatgaccggccacatgatcggcgccacgggcgccatcgaggtcatggcctgcgccatggcgctcgagcagggcgtggtgcccccgaccattaactaccacacgcccgatcccgcctgcgatcttgattacacgcccaatcgagcggttcgcgccgaccttacctgggcgctttcgaccaatctgggctttggcggacacaacgctgccatcgcgctgcgtagatatacgaggagctagagcatggattccaaaagacttgccgagatagccgatgttatggaggaccgcggcctcacgcgtgtacgcgttgaggagcccgatggcaccgcggttgaactcgagcgcgcgagcgccgcacagccggttgccgtgcccatgcctatgccgagtgccatggctgctccggttgcggctcccgcagtcgtgcctggcgcaccggagcccgctgcgcaggcgcctgccgccgcgccggagcctaagggcaccgaggtgaccgctcccatggtcggcgttttctatgctgccccggcaccgggcgacgagccgtttgtgcacgtgggctccaaggtcaaagccggcgagaccctctgcattatcgaggccatgaaggttctcaacgaggtgacggcagaggcggatggcgaggtgctcgagatctgcgtggccgacggcgacctcgtggagtttggcagctgcctcatgaggatcggataggtgatatccatgaacaaagaagagctcaagaagctgttgccgcatcgtgagccgatgcttttgctcgacgaagccgagctagtgggcgacgaggcccacggcaagatcacgattacgggcgacgagtactttttgcaggggcattttccgggaaacccggtcgtccccggcgtgattcagtgcgagatgctcgcccagaactgctgcgtgctgctgatgatctggtgtgctccatcacgcgtgcgcgcgggccgttccggtttgcgacgggcaccgcgagcgtcaacggcgaggtgtgttgccgcgccgatatgtcctttgcactcatgcacgaaagttaaggaaggcttcatgttcgacaaagtgctcatcgccaaccgcggcgaggtcgcggtccgtgttatccgcgcgtgccgcgatatgggcatcaagaccgtcgccgtctactccacggccgatgcggacgcgctgcacgtgcagcttgccgacgaggcgtattgcatcggcggtccgcgtcttgccgagagctacctcaacgacgatgccgtgctcacctgtgccgtaaagtcgggggctaaggcgatccatcctggctacggtttcttttccgagaaggcgagcttcgtgcgcgactgcgacaagtacggtctggcgtttgtcggtccttcggccgaggtgatcgacagcatgggcgacaaggatgccgcacgtcgaacggctgccgcggcgggcgtgcccatcgtgccgggctgcgatttgctcaaaagccccgaggaggcaacggccgaggccgagcgcattggctgccccgtgcttattaaggcgcgcgcgggcggtggcggccgcggtattcgcaaggtcgagcgcgtggaagatgcggcaaaggcctttattgaagcacgtgccgagggcgaggccgtttttggcgacggcgagtgctacatggannnnnnnnnnttcgtcgcgccggcgcaccacgtcgaagtgcagattatggccgataagcagggccatgtgttttcgctcggcgagcgcgagtgctcggtgcagcgccgcaaccaaaagctgatcgaggagagccccgcaccgtgcctcgacggacacgacgatattcgcgcgcacatgcacaaggccgcgcgcgacctggcccgtgccgtcggctacgaaggggccggtaccatcgagttcctgtattcggacgacggcaatttctactttatggaaatgaacacgcgcttgcaggtggagcatccagttacggagtttgtgaccgataccgacttggtcaagtggcagctgcgcgtggcggccggccagcctctgccctttgagcaggaggacatgccggtccgcaaccatgccatggagtgccgcatcatgacgtccaggtacgtggtgtggcatatgaagcgcccgtcctcgcccgggtgggcctccaggtcgcgcgcctccttgttcacccagttgcgagccgagcggggagggttgtagctgtagaagacccagaacatgtcgccgccgcgcaggaacgtggccagcacgctgcgcacctcgtccatgccgtcgaactcgtcgacctcctcgaaccacaccacggcgcagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaggccgaagtcgaacaggcgggccacgccgagcacgtcgcacgcccagcctatctgctcgtacacggacgtgcgcagcgtgttgccgaccttgcgcagcacgacggcgttggcctccgggttgagcatgaccagcagcacgatggcgatggatatgaacgacgacttggtggagttgcgcccgcccttgaaccagtagtgcgtgaactcgtgcgccttgatggagcgccacacgccggcgaacacggaggccacgacgtccgagagcctaaccgaggtcgtcaacgatggtcacccccgcctccgccatggcggccttcgcgccgtccacgccgaacatgtcgttgagcagcttcacgctctcggttatggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcggcagtccttggcggccgcgtcgcggatttcctggattctgtgcgcgattcgtgggtctcgcatcagcttggaggcggcgcagcttatcgagttgtagttcatgcgcttgcagtcgtaggccgcgcggtacgcgtcctgctgctttgcgcggggcttggccatctcgcgggcgaacgcctcctgcttcgccgtgagcggcttgtccttcttgggcacctgcggcctccttcccttatctctcggcccatatggtcgcaagcgtgtcgccgggcacggaaaaggccgccccgaaggacggccctctgcctgtttccgtattcggttgcccctatccgcacgccgccacggccatggccatgagcccgagcgccagcgcccttatggcgtagatggccgccgcgtctatggcgattgccgccgctatgaacagcaggcacccccagttgcatcccgggcggttcatcgctcctcccactcgatggtgccgtcgtcgtactcggccttgagccattccaggtagtcggcctcctcgcagaagctggccagcagccgcttgctggtagtgcagctgctcatgcggctcgtctcatacacggcgatgaagaagggccacgagtggaactccgtctccgtgtggatggcccgctcgggcgtgccgaaaaggtgctcccagttcgtcatcgcgccccctccttcgcgctcggcccgaccttgcggtaggtgaagtcctcgaacaggtggccgcaccagcggcagcggtcgccgcccttgggcaggtggtgccagatctcgcgcatgccgcacttcgggcagcgcacctcgatactgggtcggcgcttcggcttctcggtctgctgctccatggctactccaccgccatccgcatggccggcttcatggccccgcgcagtctcttggccagctcctcggccgttacctcggccttcacctccacgttcacgtcgggcatcgcgaaaccgtgcgcctcttcggccttgaggcaaggcatggcggcgtcctgggccgcgcccttgagcgtcggtgacgctgccgccctcggctcgcagcgccccagccacagctcgcactcgtccagcttcgtgagcgccagggcgcgctcgcggctcgcctcgtaggccgtctcgatgcccttgcgcaggttctgcacggccgtctcttcggttccggcgtccagcttttcgcgcagtagggcgttctcgaacctcaggttgcgagcctcgcgacgcggcactgctaccgtatgactttgctgctcgccccagcagtcctcgcacagcggcgcgtctacgcccatgttgtcctgccgcagggcgtcgatatcgcgcccgcaggtatcgcagatgattcccatgtctactcccttccttccggcttcaccgcgcctgcgaggaaccacgcccgcaggctctcggcgcactccgggcacaaggccctcgccttgccgtcgattcgcgcgctgttccccagcaccatcttggcgtaacccgccagggtcgccggcacctccttgccgcagcgttcgcatgcgcacatgtacagcctcatgcctgctcgcctcccttcggcagagcgtcggcgattcggtcccagtcggtggccggcctctcgcaggggtactcgtaggcccccacgcacggcaccggcagcaccgccatgccgtcgtgctcgcctgcgtactcgtctgcgtccgatctgctctcgaatgccagcaccacgtcgctctccgtggccaccgcgtagatcttcttcatcgtttcgtctcctattcgaactcgaagcactcgcatgcctcgcttgtctcgtccaccgcctccacgtcggggccgccgccagtcatggcgtcgcaggcgcacacggcctcgccgccagcgccctgcacacggccgcagaagcggcactcccggcacgtgcagccctcccacgggtcgggccggttccacggtgccctggggnnnnnnnnnnnnnnnnnnnnnnnnnnnnnnnttccggcagcagcaggtactcccagtgccccgagcccggcggggcggggcggttgaacctctgctcggccctgacccagcggaagtgcagccggttggcgtgcgccagcccgtggcagccgctgccgttgccgctgccgcacagcatcaccgtgggcttgggaacctcgcgcccgtcgcggaacagcttgcccgccccgcgcctcacgatgtggtgtgcgccgtgtgcggcgcgccgtggccgctcaacacaccgtgggctttatgggtgacggcattaacgacgccgccgccatgcgcgcgagcgactgcggtatctcggtcgattccgccgtcgacatcgccaaggaatccgccgatatcatcttgcttcagaaggatctgggcgtgctcgagcgcggcgccatcgaaggccgtcgcacctacggcaacctgctcaggtacctcaagaccacggtgagctccaactttggcaacgtgctgtccgtgaccgtcgcgagcctgttcctgccgttcttgcccatgagcgccctgcagctggtgctgctgtcgctggtctacgagatcgtatgcatcgcgctgccgtgggacaccgtcgacgacgcctggactgcccgtccacgcgcctgggacgctgcgtccatcaaggactttatgctcgagctgggccctgtgagctcgctgtttgacatcgtgacctttgccgcgctcttctttgtggtatgccccgccgccgtggacgcgagctgggcagagcttgccgccgcggacgacgtcgcaggcatggcggcctttgcggcgctcttccagagcggttggtttgtcgagtccatgtggtcgcagacgctcgtgatccacatgctgcgctccccgcgtctgccaagcccgcgcgaccacgccgcccccgcgctgtgcgtgctcaccgtgctgggcctggcgctcgtcacctggctgccggcaagccccatcgccgatgcactggggctcatgccgctgccaacgagcttcttcgcgctgctcatcggcatcgtcggctcctacatcgcgctcacccagctggccaagcgccgctacatcgcccgccacggcgagctgctgtagcgttgccagcaccatcgtcaagaatgcctgggccgccgcgatccgcccccgccagtcgcagcggcccaaaacagctaaaaaagccccgtcccaaattaactagtcatttggtgtccaagaccagaagaagttaataagggccacgcgcgaggcggcaccggtctttttgttgattgaggcgatatgacggtagagcgtagagcgcgaaaggaagagcgttgcagcgatatcctgaacgctctcgtgcnnnnnnnnnnnnnnnnnnnnnnnnnnnnnnncctccaaaatatcgcgctcgcgctctgtaagctcaagggcggcgacaaaggcatggagacgttcgtcgagcatgagttccggcacctccgcgaaggcgggctcgctctgagcagacacgaggtccgcgccaagatcatcggcagcaaacgccagctcgtcgtgcaccgcagcgtcatcgccccgatgcccagactgccccagcagcgaaatcgcaatgcccacaaacagcacgagcaccgcacccaccgccagcagcacgctctggctcgaaacaatcgccaccgccggcgccgtcacgagcgtcgcgcaaacgacgttgatgacacgacccatgcacggccacagatacaaccagtgcgcgtaaaccgaaatggcagcaaatttcgtcgtgaaaaacactacgaagaagcccgaacccagatagaaaatcatcatggcagcaagcgcattgccgccattgccgtcgacgagcaagacaaagaacgaaagtgtggacagcatggcagtgcaagtcatggtgatgttcatatacgaacgaccgtgcaggtcaaatagggcgccggcgaccagtgcgctcacgcccatcagcaagcgcggccaatcgcccaagtcgatggccccggcggcgtgcgaggtcgtgagccctgcattgagggcggcaaacacaccggtaaggcaggcggttgcgaccgtcagacgcaccacggcgcgccgaaaagccgccgttgattcagaatcgtcttgccacttggcgccaaattccgacgcatccaccgaaagctcggcgatatcggactcgcgcccaacctcaggcccaccgtgtagcttggcgcgacggacgttgtggagcagtaccacctgcgcaaccgcacaggcaacaagaacaaactgctgcggaatccccgcaggcatcaccatatggttgaacacctgcagcagaacgcccaaagcatacgaaagcgccaacacgcgcgccaaatacggcgtacgcgcaaagcgtcgcgcaaagttggcgtgggcggtcgacccgcagtagcccagcgtgcagaacgtcagcaaaccgccgacaatgagcatctcaaattgagccgccatcatcaacagcagcaacgccgatgccagcaacacgcccgcgatgtcgcttgtcgtatcgatcgcacggggacggcggtagtacagaaggggacgcacaagaaagccgattgcgctcgcgccgacgatgaagctctcgtagacaacgacctcgctcggcggcacaaactcggcaacgcgcacgtcaaaaagatactcgccagccaaatacgtaaaatagaacagcgctaggcatataatctcccgaatgccccgacgcaggtatgcggctgtgtctcccatgcctctcatgaatatcccccccccgccgctcaactgtttgaatttcaattttaataaagaatcagtcccgataacgaagccaagctcgaaatgccgcgaatttgaccccagtagtccacggcgtgcagcgtttttgagccgtctgtcccagaaggagcacgacgtggactgcttgctcggcaaagagtgtccccggcgaccagtcgtttaagaacgtccccaatgactaccctagagctctcaacccttcatctatggcatttcttttagcagacccgccatatataggggcaaatacaatatcgcctttccatccaccacgttgtcccggtgaagcacgaccgcccgagccaatccatagttttcaacgctcatcaggcgatcgagggcaacgtgctttgtgctgtacctacccgatttgacctcgataggcaaaacgacggggctccgcttatcctcgataataaaatcgacttctccaaccttggccgcgttaaagtagaacaacgaagagtagccgcatgcgcgcagctcctgggcgaccgcattctcaaaagcctgcccaaagttgaatgcgtggaaccgcgaccacgctgcaccgcagaggacgtatcgcgggcgggctagatgatgtgttatagtagtacctgtaatacacgacaaggaggtgcgacatggctaccgcggtcacatcaatgaggattccaaccgagttgaacgagcgctacagccgtcttgcgaaggagactggcaggtcgaggagcttctacgttaacgaagccctgcaagaagctatcgaccgtttcgagtacgagtacgggattctcaaggatatcgaggactatcgtgctggcaggcttgagacctacagcatcgacgaggtaagggcgcactgtggcctggcgaattgatttcacgaggaacgccgacaaggcgatgcgcaagctcgataagggcgttgccgcgcgggtgtttgacgagcttgacgagatagcgaagctcgaagacccaagaagcaggggcaaggcattgacgggaaacttggcaggcgtgtggcgatacagggtcggtgactaccgaatcctgtgcgacatcaatgacggcaggctcgtcattctcgtggtcgatgttgcgcatagacgcgaggtttacaagcgcagataaaaaaagaaaagccccagcaagcttggcggcagcaggggcattcgagacaaggagattatagcatggcggcaaacgctggcgagacgaaggtgaagctctgggagggcatctgctacccagagaacatgcgcgatgactggcaggacgagatagacgacattcttcaagtgcctttcgcttatgcggttcacgacatagaccatgaccagaagagcaagcagcgcaagacgcatgcgcacgtcattgttgtctggggcggcaacacgacacgcaaggcaatcatcaacgtcttgaaccgattgagcgcggacggcaagaagtgctgttcgtcagccgagccaatcaacaacatcaggcatgcgtatgactatctgattcacgacacggcttcctgtcgcaagaagggcaaggagctgtatccggtcgaagcacgcatcgagggaaacaacttcgacattggtcagctcgaacagctctcgactaaggacaagcaggacatgctcttcgagttggtcggcttcatcatgtgcgagaggttcgagaccatcaacgatttcacggctgcggcgctgagggagtttcccgagcagtaccgcgaaatcatcgtggggtacaactcgattctcgagcgctattgtcgcgggaactatctgaacgccgaacgtaagcgcaagtgcgtggaacagtcaggtgccaaagagtagtcgggtcaatgcagcaatgcgtgactacggggcggcgtggtctgcgctcgcgcagatctaagccgactcgttcacggattgcggaattgacgcgacggccaaccgaatagaccagacttgattaagggtcgatggacgctctgctccatcgaccctttccttgcccgtgtctcgactggatgagacctgcagaatcgggcggctcattatttttcgctaactacgtccgaaaaataatgtgacaaatgacaaatgacaaatgaccacagggggggcgaggtactacgacctcgcccatgggaatccgatatccgataccgatacgtcggggtggtttggaggggttttacccctccatctcggcggagccgagcgggcaaggaagaggtgccgccaccgatgacgcgcagcaatctcgaccgctgggaggattgcggagaagccccgcagggcacgtccttagcgcagctaaggtctaacgtgctagactttaggcgactaaaatctgacgcaaggcggttccgacatggcacacatagcgaagtacaaggcaacctcggtcggtcacatgcttgcccactacaggcgcgacgagtccagtctgggtcgcgacaacatcgacccgaagcgcgtgaagaacgacatggtcgttgcccactacaccaacaaggacgggaagctcgttgtggggcgcgtggtgccccgtgagggcgagccgaactggggcacggtggagcggcgcatagagcgcgtgaacgaggcccagaaggccgcagggaagcgcgcaacgcgcaaggacgcggtggttatggccgacgtggtggtgacgcttcccgataacgtccgcaagggcgatgaggataggttcttccgtctcacgtactggtacctgtcgaacaagttcggcatcgacaacatgatgggcggatacgtccacaaggacgaggtgctgaaggacggcacgcccgcccgcgatcacatgcacgtgccgttcacacctattctcgatgggcgtttcaactacaagaaaatgtgcccgcgctcgttctaccagtcgatgcacaaggagcttggggactacctcgagaagcgcatgggctaccgccctgcaatcgagcttgacgaggagacgcgggcgcagcgcgtttacacggacaagtccgtggacatcgacaaggtacgcggggcggtcgatagggcggtcgtgcaacctgccgaggacgaagcggcgcgaatcgtcgcggcggctagggaagaagccgccgctttgctaaacgatgccgaagcgcgtaaggcagagcttgttaccgagattgccgacaaggagggtgaccttgccgagcttgacagccagctcgaggacgtgaagctcgatatcgaagatgagcaagaccgattggagtgtcttcggcaacgagcggacggagttgcgcgagacgttggagagcttcgctccatcgctgccgaggttcggggctgggaagctgcgggaaaagctgagcgcggcgcaatcctcgatagaatcgctgctcagtgcgatggactcgcgagccgcatcagagcaggagttgcgggaattaggctcaaagtggaagagcttagaagccgaatatcgcgcccgctcgaatatctgatgcgcagggagcagccaaggcaacagagccttaatgacgtgctgcgcgatgcgcagcgggcggcggatgcgtggaaccgcgaccacgctgcaccgcagaggacgtatcgcgggcgggctagctcgtgagcgtattttgcatagatgatatgcctccggtcacactcaagaccgttggatacggcaaactgatccttgggatcgctcacggtatccataagcgatgtgcccatgagcaccgatccgcgcacccgagacgacagcacctcgaggccgccaggaagcggattggcaaccgccgtgcaggcgaggccccgctcgtccagagcagaaaccgccagcgcgactccgccgccaagaccctcgccccatgcaaagatgcggtcggggtccatgccatcaagattgcgcgcgacctccgccaacgcgcagccccaacggacgcgcctgacaaaagcaggcgaggtaatcccctgccgcagatcgctgggtccaatcgcctcatcgtccagcgcaagcacggcatatcccatggccgcaaacctcgtcatgtgatgccatccccgcacgggtcggtcgatgtcgtgaaacatcagacatagcggcacgagctcggatgctcgggcgcgaccgacaggctcgatcaaacgtgcgtggaccacatcgccaccaagctcaaaggaaacctcggagtagcgggcatacggattggcgaaatcgatcgccgtaatactcggcccgcaaacctcaaggtccgaagcggctatctctaattcggaaacatccgcagaagcatcaccgcgccaatcccggaaatcagcgagccttgacgagaccgttccgggaatccccacaaggtcggggacgatcagctcgccgacattgctctcgcacttagacatgagcctcccctcccttgcagaaaaacggaatgatcagatcgtcaaaatcctgaatctcctcgtggccaaagccttcaaagaactcatgacgcttttcacaggtcaggttgttatagaccgcaaactgcgtcgctggcggacagacggtatcggctgtgccggtgccaaacagcacggggcatttgaccataggggcaaagttcttggaatcgaagtacgccagcttggcataggcttcgtcgatacgagtcgagtcctcgtcaaaccagcgagaccaatagcgcaggccctcgtaggcaatgtcgtcggcatccaaatcccagaccaggcgaaaatccgacaggaagggatagaggatggcggcgcgattgataagctcgctgttaagtgcacaggtcgcaatgcccaaaccgccgccctgcgacgcgccgttcacaaannnnnnnnnnnnnnnnnnnnnnnntatggcccgcgaccgtcgtaccctcaaatccaccaatgtcctcggaaggacctccttggccggggcagtcgagggcgatgagtgccatgcccatgcccgcaaacgacgcctgctcaaaccagctgcggcttgcacccggatacccatggaactgaagtaccaatggcacgggctcgtccgagacgggtttaaggtacttggcatgcaggcgagcgccacacatgccggtataccagaggtcgaaaagctggcaggtcacggcatcggtgaccgatgccgtctcgatcgcatagtcaagcccgacggcgtcggcctcggccatgcggtccttccaaaagagatcgaaatctgatggacggggcatggcgcctcgatattcaccaaattgatgttgcagctcctgagcacttggcatggctcgtgaacccaacctttcgaaatcgcaacggaggtgcgcccggcaagggaaccgggcgcacgggagggaaagcgaggcnnnnnnnnnntcgccgagcttgggatgcagcagcgacggcgcagcgccgagcagcatcttggtgtaggggtcctgggggtgctggaagacctgcttggcctcgccctgctcgacgatcttgccgccattcataacgatgatgtcgtcagagatatagcggaccgtctggatgtcatggctgatgaacaccatggccaggccgagctccttcttaaggtcggtcagcaggttcagaatctgcgcgcggaccgaaacgtccagagccgaggtgggctcgtcggcgatgatggcatcggggttcagcgacagggcacgggcaattgcgacgcgctggcgctggccgcccgaaagctggccgggaagaacctcagcggcggagctgggcagaccggtgagctccaagagctccttgacgcgcttctcctgctcggcctcggtacccaggttgtggacgcgcatggggtcgagcagttgctcgcgaacgaccattcgggggttgagcgccgtggccgggttctggaacacgaccgagatgacgcgacccatgtggcgacggtcctcggcggtacgcttggttacgtccttgcccttaaagtagaccctgccgctcgtgggggcctgcaggccgcacatgacgttggcggtggtggacttaccgcaaccggactcgccgacgatgccgatcgtctgaccgggcatgagcctaatcgttacaccctggacggcgtgaaccaggttggggtgcagaatcgagccggtacgggtcctaaaggtgacgtggacgtcatcaaggaagatgatcggctcgacgccgttgactgcggtctcgctcatctacatcacctccgcgtgaggggtcaaaccatttgccttgagcacctcgtcggggagctcggaatagaagtgctcggtgccgggcacgcgcttgaagaccggacgggtgtccaggccaatgcgcggatggctcgagcggggcgcgaagcgatcgcccttggggaaatcgcgcgggctcggaacggcgccgggcacctggtgcagacggcccgaaccgctctcgatggacagaacggagcccagaagaccgcgggtgtactcgtggatcgggttagtgagcagctccttggtgggcgcctgctcgataacctgaccggcgtacataaccgtgatgttatgggcgacctcggcgaccagcgccaagtcatgcgagacgaagatcatggcaaagccgagtttggcctgaaggtcgttgagcagcttgatgacctacactgcggaaaaacaccgctcacaaagcggacgccaacttgctaaaacacaatttcgaggcggagtgcgcgtggctgatgacggtcgcgaaccggaagacggtcagcggtttccttcatgtgtcgtggaggaccgccggcgccgtcgcccgtcgggtcgcggaacgcgtcaaggcgtcgatgccgtcgccgttcgacggactcaccgcgatcggcgtggacgagaccagccatcgcaagggccacacgtacctgaccgtggtcgtcgaccacgagcggcaccgggtcatctgggcgcacgacggggtcggcggggacgtgttcgacctgttcttcaaggcgttgacgcccgaacagcacgcctccatcagggtcgtcaccggcgacggggcccgctggatcgacccgtgcgtcggccggtggcgcccgaacgccgaacgcgtattggacggcttccacatcgtcagctggatgaccgacgcgctcgacaaggtcaggaaacgcctgtggaaccaggcgcgccgcgacggcgacgagaagaccacgaagcgcatgcgcggcgtcaaatacgcggtcctgaagaaccccggcgacctgaccgacagacagtccgaggcgttcgggaacctgcggaacacaggccccaagggccagctctaccgttcatggcaactcaaggaactattgaggaccctgctcaagcacccgctcgaacaggccaggggcgagttgaggcactgggtgttccgggcctcgcattcacgcatacccgagatcgtcgaaccggcgaagaagatccgacgccgccggccggacatcctgcgcacgatccagctgggctactccaacgccaggctcgaggccttcaacaacaggatcaaggtcaccatccgcatggcctacggcttccaccacgtcgacaacctcatcgccctgatcatgctccgatgcggtggactcgacatccgactaccacaacccacgatctaacccacgaaaacagcagaagcctcaaataagtcccatacacaaacaattcgacaagctcgtcgaacaccttctgtccgtgaccctgatgcatccagatgacgcgccccggtcgtggtcgacgaccacggtcatgtacttgtggcccttcctgtagctggtctcgtccacgccgatggaacgcggcccgtcgaacaggcccggcccctgctccgctcgcaggtcgtcggcgacccgtctgcataccgggcccacgctcttccagtccatgcgcatcagccggctcaccgcgcttctgggctcgtgcacgttcagaagcgccgtctgctgttcgaaatcgcgcgtgtacgcgctcttgcgtctggcccacggcatcatcgcgacggtcacgccgtgatcagcgcatgtcacgtgcggcggcgcgtactccagcatgagcctggcgcacccgatgtcgaggtgacgccaccggcgcacgcctagccggtcgtacggcctgacatgcttctcgcacctggtgcaccggtccatgtccttcgcgtacggtcggaccgggactatgacgacgtctccgccatgtgggtccttctcgatgcgcggcacgccggctgatatggtgggcaaaggcgttccctctgtttttctgtttgtgtttttggcggaaacaaacctaacaggagaacgcccctttcatacccgcacacaggaagaacccgtcaacgacaccgaccccgcccctcactacacaaactggcgaagactcaagaaaactcagtatgacccagttcccttaaacacagcgactactgtcttcaacagaatcgcaatatctccggtaatggaccagtcctgaatatatgacacatccgcatattccgactgtttctgagtcaaatcgctgcgtccggaaatctgccaaggcccagtaataccaggcttcaccaacagtcgtgtggaatacagcatgccatatcgtgcgacttcctcaggcagcggcgggcgaggcccgaccagactcatatcgcccttgaacacgttaaagaactgcgggaactcatccagagacgtcttgcgaataaaatgaccgatcttggtcacgcgcggatcatccttgagtttgaaaacgaagcgatcctcaatgccacgttccttagccaatttggccttgatcttgtcggcatcggtacgcatggaacggaacttatacatggtaaacggcttgccgtaaatgccaatgcgtgtttgtgaatagaacaccgggccgccgtcttctcgtttgactttatacgccacccacagcatgatgggcgagctcagaataatggcgatggcggaaagcacgatatcgcaaatacgcttgagaatgcgagtaatggctgaatactgcgtgagtctagcagtgaccaccggcatactcggattattgcggaagtgcagatctgcgccgcttagatcggccacggacgcagtcattgccaactcaatgcccatggactccaccgcgagcgacaacgtacgcatggtttcggaatcgcgggtcagtacgtcggccactagcacagtgcgtgctttcatacgcttggctgtctgaggcagatgggaattaagtggcaataccttcaaccgagcttcgctatcattagcgggggtgaatggtaccgacaccagatgctgagcctgatcggcatcatcctcttttttggccgaaacaaccgggcacacagcaaccggtgcatagccaacacttggacattggcgcaattgttcgagcgcgtcatggattccttctggagaaccgattactaccgtgggatagttgaattcgcccttcatacggttgcggtgcaaggcacggcgcatcgcccaacgctcgatgatgaccagtactagtgaaactagaggaacgaagatgtttaatgaccggggaagactgagatggaagagcccgatgtctatttagaagtgcaacacccttgttggtcctgtaattctaacagttgccatcgatatcggcaacggcttccttccagccgtcgagccctcgcacgtcggtaaagaagtcggcgtcggggttcttgcccgtcaccaggcaataggccgagcgcacggcggcctccatcacgccgcccgtggcgccaaagatcacgcccgcgcccgtgccaaagcccagcggcgtgtcgagcggctcctcgacgagcgtgtccacgctcacgtggttcgcgcggatcatgcgcaccatctcgcgcaccgtcagcgcaacgtccacgtcgggcgcgccgccctcgcccaccatgctcggcagcgcgcactcggccttcttggccgtgcacggcatcacggacgccacaaacaggcgctcgggctccacgcccagcaccttggcgtaataggtcttggcgatggcgccgaacatctgctgcggcgacttggacgtggacaggctgtcgacaaactcggggtaacgtgccttcacaaagcgcacccagcccgggcagcagctcgtgaacatgggccaaccgcggctgtcgccctcgcccttagcggccttacccaggcgctcgagcagctcggagccctcctccataatggtgaggtcggccgagaaatcggtgtcgaacacgtactcaaagcccacgcggcgcagcgcgcaagccaggcgctcaacggttgcttcctcgcgcggaataccgagctcctcgccccaggcgctgcgcacggcaggcgcgatctgcaccagcacgatcttgtcgggattagcgagcgcatcaaacacggtctcagtatcgtcgcgctcgcgcagcgcgcccgtcgggcaatgcgtaatgcactggccgcacgcgacgcaatcggtcttgccgatcggcgcgcgcccgcgggtacccacggcggtatgcgtggcgcggttggtcaggtcccaaatccctaggccctgcacgctctcgcacaccttgatnnnnnnnnnnnnnnnnnnnnnnnnnnnnnnnnnnnnnnnnnnnnnnnnnnnnnnnnnnnnnnnnnnngggaaaatcgaaatcccagccctcgcccgccaaatgcctttgatacggcagatagaaaatgcccgggtcgttggcgatggtctgcaggttgcagttgccgctgcgcacgcagctcgtgcactgcgaatcgtgctgggacagcagcagctgcacgttggtgcgacgggcctcgcgggccttggggctgttggtgtggaccaccatgccgtcgagcacgtagttgttgcaggcggcaaccagctggtcgcagccctcaacctcgaccacgcacacgcggcagccaccgatctcgtttagatcgcgcaggtagcacagggtgggaatctggatgccgacggacttggccgcatccaggatcgtggtgtgctcgggtaccacgacttcgcagttatcgataatgagcctgaccatgttgtgcgctccgttttcgctgttgtcgccgacagtggttttgttgagctctaccattccaggttcctccctccgcggaacgcgccaaagccaaagtggtcgcaacgcaggcagcggcttgcctcctggcgcgcctcctgctcggtgagannnnnnnnnnnnnnnnnnnnnnnnnnnnnnnnnnnnnnngcctcttaaactggacggtcggcagctccacgtcgagcttaatcttgtggtcaaagcccaggtagcggtcgatatttgccgaagcaacgcggccggcgttgatggcccggatgacggtggcggggccggtctggcagtcgccgccgctaaagaggccatcgaagttaggcacggcgccatccgaatcggtgaccacgcagccccacttacaggcaatgcccatgtcctcaaacggcttggaatcgatgccctggccaatggccacgaacacgcgctcgcagggaatgacgcactcgggcgtcgcggcggcacgcggggccggacgaccgcgacggggctcgccgataatctgcggttgcacgcgcaggccgctcacgcgtccgtcctcgcccgtctcaataccgagcggggctgtgagctccaaaacctcgcaaccctcggcctgggcgccggcaatctcggcgtcctgagccgtcatatcgcagatgcgacggcggtagacgatgctcactttttcggcaccgcagcgcacggcagagcgcgccacgtccatggccacgttgccgccgccgatgannnnnnnnnncgcacacgcgctggccgctcaggtcgggcagctcgtcgtctccaatggcgcgcagcatcttgacggccgactccacgccgggcgcctcttcgcccgggaggccgagtttcttgtcgctgtgggcaccaatggccaggtagacggcatcgaactcgtcacgcagacgggcaagctcctcgccgttgacggagtggtcgagctgaacgtcgataccggcgctcaagatccagtcgatctcggcctgcaggcgctcgcgcggcaggcggtagctgggaatgccgtagcgcagcatgccgcccaggtggtggcgctgctcaaagatggtcannnnnnnnnnnnnnnnnnnnnnnnnnnnnnnnnnnnnnnnnnnnnnnnnnnnnnnnccttgtggcccatcacggccaggtagtaagcgcaagaaagaccggccgggccgccgccgatcacggcgacgcgcttgccggtgttgtccaccacatgcggcttgtggtcgttgaggtcgctatgctcaacggcaaaacgcttgagagcgaggatgttcatggggtcgtcgaccatgccgcggcggcagtgcatctcgcagggatgctcgcacaccaggccgcagacgagcggcagcggattgttcttgcggatgaccttgacggcgtcggcatagcggccggcctcgaccagcgaaatgtacccaggaatgtcgacgtgcgccgggcagcccgaacacaagttcgcagccgttggctcttgccagggctctgcccttggacctgggtcggtaagttgactgcgactgcatcggttgattgatggcagttggaatcgacgccgtagtttttaaatctgttatgaagcgtgaaactcaaaaactcatcgtattgattttcatttgattcgaaacgcccgcgcaaaagtcgaaacggctcgcgcgggcgtttcggtttttcgtttcgcatctcaactcgcgtcaaaacaaaacgcgagctttgaaaatcgatagcgaccgaaggtcgcgatcataggcggcttgaccgccgcatgaaaatcgaatcgccattcgaaccgtaatgcgattcgcggtacctttcgacaatccaacaacgctacgagtctcactaaagactctccgcgtcattgaaatgtcgaaagctgcctcaactttttcgcaagcgtatcgaaaaacgattcgataaagtcgaatgtttgcgtcgcgggcgccgcaaacccgctccgctctcgctacagcgaatctctaacactcagcatccttcgcgttaaaaattcactttcgctcacggtcttcacgcagttacaacgccgcgaggcctctcgcttggaatgaggcctctcattccacgtctacactgcgtttcgcccaatccccgttccggagattgcaagattggtgttgggctagataaatggggccatactcgacccctttatctgccaacacatcttgtttatcgcctcttacggcgataaagttagaaatgaagttcgccttcatttctaagggaagtgacgacgtcacttcaaaaaacggcgcgacgtcagtcgctcctaaaaaggaaagcaatctcatatcggttttgaatcggtggcctcaccgattcgctctgctttcctggggggcatatgagttgcaagcgtccacacaccgttaaggcgacactcacttctgaagaatatgaaacgttttccgctttggcggaaaaggcaggcatgacgaaagccgaactcattcgctatgtcttgattcatcggggcgaatcgctcgatgatctagtcatttccaaaaatgatgacggcggccgtaacgaaaaaccgcaacccgtctcagaggattcggatgaacagcgttcgaaggtcatttacgttaaggtcaccgacggggagcacgaagcgatccgcaaacaggcggatgcgctcggtgcgaccgtcagtgcgtatgcccgccgcgtgatgcttaccgggaaaatcgagatgatcgattgcgatatgagccaggtcgcgaaaatctatcgcgagctgtatcgcgagggtacaaacctcaaccaactcatgcatttcgtgaacgcgcagggtcttccggcctacaacgagaaagccgttttccgaacactcgaaaaggtttaccagaacgcccgcaaagtcactctattcatcagagaactcgagcagcgctatttcattgacggcggtgagctcaatgaccgttattaagcagaaaggtgtttcatccgagcgatacgcgaaaaatgtgcgcaaatacatcaacggaaaacatgccttggctcgcggcggctggaacctcgcgaaccgaaagtactggttttctgaaatggctatgacgcggaagatgtaccaccacgacagacctgcgcgtgccggtgcgaagaacataacgatgcttcatcaaatcattgcgtttcttccggaggagtgcagctgcaacggaggcaagatgactccagatgcgtgcatggcttacgcggagcaatggcttgcgaagcactacccgcatcaacaagcggttgtcgcgttgcacgaagaaagtgacaaggaaggaaaacggtttgcggtccacatggcgattaaccgcacggaccttctgacgggtaagcgttgcgagacgggtgggcgacgcggaaagtacgaacgcgctgcgtgggtccgtgaaatggacgaggcttggaatcttactcaacttgaaaagggaaagaagaattcgaaaattcgtgatcgtcagccgcgcgatattgaaaaggagattatcgatcggggagagtacagttacaaaaacaatctgcgcgagctgatccatatcgcgatcgacgaaggtcgcccaaagaatatggggcagttcaaaaaactacttgcatcgtggggcgtagacattttcatcaagaacaatcgagtctacgcgaccgatctcgatatcaaagaggccggcaatccgaagtgtactttcaacctgactcgtcttgacgggcggtttgcggtcaagcaacttgaggcggccttcaaaaataatgttctagaagccgagcgagctcttccttatgagaagcgctgtgagatttacatccaacggcttaaaaaagcgtattcggcgtgggtcgagcaggcgaaagcgagcaagggcgtcgcctacaacgcattccctaaattcattgcaccgaagtgcgatgaagacctactcgaagaccccgccgtacgcgatgagcttcttgcccggcgcggctatgcaagggagattcgcaaccgttacgccggcgccgttcccgataccggcgacgaccgcgttcgcgccgccggccaggcgcacggcggcaccgccgcatcgcgacagatggacgatcgcgtcgttgatcgtggcgactattcgcgtggcgacacgcctcgctagggttgaactgcctgtcgtcggggcggagtaaaaacgctcatgcctcggcgatgcggcgagggcggcatctagtaccgtagtattacgtttccgcaggtaaatgaggtaaaaaaccagcgaagcccgcccgccgtagcgggcgggcgtgctatcatctgggttgtgctcgggtgttaccagcgccctcgcacgcgtagaggcgagttaagattcttgtggcaactcagaaattcaccggcgttatccctcccgtcgttgttcccgataccgaagatcaccagcttgatgttgcctcctttgagcgcagcatcaaccgcatgatcgatgccggcgtcgatggcctgttcttcctgggatcctcgggcgaggtcgtcttctccaccgacgagcgccgtcgccagattgtcgccgaggccgttcgtatcgtcgaccaccgtgtgcctgttctggtcggcatcatcgataccgagaccgagcgcatgattgagcacggcaaggtcgctcaggagctgggcgccgatgccctcgtcgccacctgcccgttctatgccctgcagggcatgaccgaggtcgaggagcacttccgcatcctgcacgaggagcttgacctgcccatcttcgcctatgacattcccgtctgcgttcacaccaagctcccctggaagctccttgccaagctcggcgccgagggcgtccttgctggcgtcaaggattcctcgggtgatgacatctcgttccgctacctcgttcaggagaacgagaagaacggccatccgatgagtatcctcaccggtcacgaggttgtcgtcgacggcgcttacctcggtggcgccgatggttccgtcccgggtctcgctaatgttgagcccgagggctatgtgcgccagtggaaggccgctcaggccggcgactgggctaccgtcaaggccgagcaggatcgccttaacgagatctcccacatctgggatgtcacctcgggcgttcagggctatgccggtggcgtcggtgccttcaagaccgctatgaacctcatgggtattttcgacagcccgaccatgccgcgcccggtgaaggccatgaccggcgagaacgtcgaggcgattaggaaggtcctccaggacaaccgcctcatgtaaagctttcccaggcacccgacctcgccgttcaaccgtgtggccatgactattaggtcaatggccacacggtttctcggcgatcttgggcacctggaaaacctttactgcgctgtgacggctagcctgacggcgcatttcctatagttgttttttatctccgaaggagagcgacatggagaacaagtacgtctgttctgtcgatatcggcggaactaagatcgcgactgccatcatggagtacccggctgacggtagtgtgccccatcccgtttttgaggccgaggttcccaccgaggcccaagagggcggcgaggccgtcttccagcgtatcgaggcgtccatcaaggctgctctcgaggcgaatcccgatgtcgaggtccttggcgtcggtatcggtgccgcaggcgtcgtcgatcccaagacgggcgccatcgcgtatgccaacgagatcatgcccggctggtccggcgttcagttggggccgcggctgcgcgaggaccttggtcttcccgttgccgtggtgggagacgtgcaggctcatgctctgggcgaggcccactggggcgtcggtaagggcaagttctccgtcttgtgccttggcatcggtacgggcatcggcggcgcatatgtcgagaacggccgcgtgatgcagggcttccatggtgctgccggccatatgggccacatcgagtgctcggctgctgccggtattccctgcgcctgcggacgttctggtcatcttgagtcggttgcttcgggcacttccattggtcgtatgtacgatgagcgctttggtcgcgtcgaccccagccgtccttcggtcggtcgcgatgtgaacgacctgtgccgtgcgggcgacgcaaaggcgaccgaggtcatccatgacgccggctttgcgctgggcgccagcttgggctcgcttgccaacatcttggatcccnnnnnnnnnntttcgggaggtgtgattcaccagggtcccgattggcgctcgcagacgtggaaggactcggtgcacgagggctatgccagccaggcgctcgacccgcttcaggacacgccgatcctcatcggttctctggagggcgacgcgccgcttatcggtgccgccgaacaccttcttgcgtcgttgaagtaaacataactaccaagtgcgccttctgaggtgccgcagattgacgtgaaagaggagcgaagcgtactttggtatgcgagcgacggtttgaacgtcaaggtgcggtgtctcagaaggctgttttgagaaaggttgagtcgaacatgaccgttgatcctttgatccagtccctaaagggcaagctcgtcgtgagcgttcaggcctatatgggcgagccgcttcgtacgcccgagaccatggctcagatgtctcgcgcctgcgagcttggtggcgccgccgctattcgctgccagggtcttgccgacatcgccgccattaagggccgctgcgaggttcccgtcatcggcctgtggaaagatggacacgagggcgtctacatcacgccgacgctgcgtcatgctcgcgcctgcgttgccgccggtgccgacatcgtggcaattgatgccactgatcgcccacgtcccgatggcaagaccgtcgaggacaccttccgtccgctgcacgaggagggcgtgctcctgatggccgactgtgccaccatcgaggatattcgtcgtgctgtcgacatgggctttgacctggtgtccaccacgctttctcatggtgttgccgctatcgattgcaccatggccgacggtcccgatctgccgctcctgcgccaggcgaccgaggaatttcccggccttcccatcatctgcgagggccgcgtgcacacgcccgaggaggcccgcgccgcgattgatgcgggcgcctgggcagttgtcgtgggcactgccattacgcaccccacgagtattacgagttggttcaaagccgcgctcgccacggtcttcgtttcggtggcttctggtcacctgaccctccttgcggtaggtcaggtgttgcaacgatcactagaacccgccagtcgcctccggcggactgaggggggggtccaccagaacacaggaccccttactgcctcagcatgccactccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaggtgaccaataccaaccatgtctgtcgatttatcagcaaacaccagaatcgccgccaacgagggcgcaatctccccggccgccgtcaaatcgaacgtacccagcccacgcacggtgccgtcaccggtcacttcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcagccacagtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcgggcgtgcataagcctgttcgtcgccatcaaaattcactgggccatctgcaaacagggcaaggccaggcacgaaacgcatcaccgtgccggccagtccgcagaacacattgacgttgccatggaatcggccggatacgggaggagtaaccgttacggtggtgtcggttgcggaatccacgtcgcagcggacaccgagggcttcgagggcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgtggcgagcggggcaggccagagattcgcgagttgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgaggcctttcgctgtttggtgtgggtgggtctgtcaggtggtgacggtgctgaggtcaaaagcaggcgcaagctgcggaaatcgaccgccgaatcgcggaaaaaatggccgaactcgaccgcttggacggcgaaatcggcgaaaaaatcgagcttcgcaacgaggtgggcgacaacctgcagcgcgagcagcggcgattggagtcggttcggcaagcggcgggacggcttgaggaggacgttgaggagctggaagccatcgcttccctcgctgaccagttcgaccacgcgggccgctttgaaaagcgcggaatcctcgatgaaatcgctgctcgatgcgatggactccgaggacgagttgagcaggtcgttgagggaatcagaggagcggttggacggcttgaggtggcaattgaagacctcgccagaaagctcgcgccgagaagtgcgcggatgacgacaagggcgctcaaacgcgatttggcggccttggagaaggacatgagtcccgtgacgctggcgagcgaagcgcgggatgctgcaagggcgtctaacgcccgtcgcgggaatgtcccgcagcgggatcgcgggcagagccgctagcacacggggccgctcaaacgtaaacgatagtttacgtttgctggtattacagaaaaccagcatctaactgcggtgatgggcaaaataaaagcccaccgcgcaagcgcgatgggctaaaatgtttgattgtcggctgtggttgccgcctcaaccgacaggaaaagtaacggataacggctccgctacacacagttagattctaccagttttcccagcacaacagcatcctaccaaggaaaactaacagcaaattagacctctaggagccgctttccacgattagaaagggctccatttttatggccaaagaggaaaagactccgaaaatcgcaaaggctcggtactggtgggcggttctctatcaggagaacatgcgcccagactggcgtgaagccatcgatgacttgctccagcttccctatgcgtactgcgagcacactgccgacaaggacagcaggagcgagcaccgtaaggaccacgtgcacatcatcgtggccaaatcgaataccaccagctacaagcacatcatggaggtgttcaatctcctttccgcgccaggcaagaaggcgctgaacacctgcgaagcctgcgtgaacatccgacactgctacgactaccttatccacgacacggactcgtgccgcaagcagggaaaagagcagtacgacccgagccgccgaatcacgggaaacaacttcgacatcggggcttatgagcaaatcagctctgcccagaagcaggagatgttgaaggagctggtcggctacataatcgccaacggtttcacgacaatcaacgatttcacggtcgcagccatgaacgatttcgatgggtgctactgggaaatcatcgtcggctataacggaacccttgagcgctactgtcgcggcaactacctcaagcgcaaggccaaggcagaagctcgggatgcgggcgagtaggcgggtcaatggagctatcggtgactacggggcggcgtggtctgcgaagcagatctaagccgactcgttcaccgatagcggaattgacgcggcggacaattggaagaccagactgggataagggtcgatggacgctctgctccatcgaccctttccttgactgtgtctggagtccgaaaaacccgcgtttttgggggtcagtatttttaggctaactacgacctaaaaatactgtgacgtgtgacggacgacaaaacgggggtttcaaaaggggcgagttagccccttttgggggtggttcggaggggcgaagtccctccgttcggcgcttgcgccgatggcccgcacctcatgagcgacgtcgcgaatgagtagggctggggggtctaggggggaacgcccgagcgggtcaagggcggcgcccttgcacggccaaacgcagtttggtataccgtgactataccaaagtcgctaacgcacctttaggtggttcgaactcgggagtttgacatgaccgtagcacccttgattgccatgaagtcgaccaaatgcgagagccttgaagccgtgggcaaggagctggacaggcgggcgcacacctacgccaacgatgttgacaagagcggccggcatgtcgggtacctgtgccgtgcgggggacgagagtcccgttccgctcgaacaggccatcgagcgccgtatgggcgagctgaacaccaagcggaaaatcagggacaaccaagtccgcgcgatggggttcatcgtctcaagcaacgatgccttggacgagaaggacgcgagggagtttctggataggtcggttcagtggttcggggcgcggtacggatacgagaacctgctcgccgcccagattcatttggacgagggcacgccgcacgcgcacatctggattgccccagtcatccgcggcgaggacggccacgatcgcctgtgcgccaaggagctgttcgcgcccgacaaccgtcgcaagaacgcggatggcaagtgggaggtgacggcccagggaaccatgagcaggcttcaggaggacttctgggagcaggtcgcgaagccctacgggtacgagcgccccctgcgccacgagcttcgcgcgaagggctacaggagccttgatgcgtacaaggtgcaggtcggcaccacgcgagcgctcaagtccgagatagagacccttgagggtgcgagggacaaggcgaagcgcggggcgatagctgccaagcgcgagctggacggtctcgagcagcttagggttgagagccatgtcaaattgggtgccgtgaccgccaaggtcgatgaaaagcaggcgcaagctgcggaaatcgaccgccgaatcgcggaaaaaatggccgagggtccaggcattcctgcaggtgtcgcccgagctcgcgctcgaggccgccgcgcatgtggatgccgaccgtgccgccggaaagccgctacccccgctcgcgggcgtgccgctggccatcaaggacaacatgaacctcgtgggtacgcgcaccacctgcgcctcccacatgctcggggattaccagagcgtctacaccgccacttgcgtccagcgcatgctcgacgccggctgcctgcccatgggcaaggccaacatggacgagttcgcctttggtagctctaccgagagctcggcgttccatcgcaccaacaacccttgggataccgagcgcgtgcccggcggctcctcgggcggctccgctgccgctgtcgccgcgggcgaggtcgcgctctcgctgggctcggacaccggcggctccattcgccagccggcgtcgctgtgcggcgtggtgggctttaagcccacgtatggcgccgtgagccgttacggcgtggttgcctttggctcgtcgctcgaccaggtgggtccctttggccgcacggtcgaggatgtcgcgctggccatgaacgcgcttaccggcgcgggccacgatccgtatgactgcaccagccaggattgcgccgtcgactttaccgagcacctcaacgacagcatcgagggcaagcgcgtgggcattatccccgcgtttatggaggccgagggcctgacgcccgaggtcaaggccgctgttcagcgcgccgcccaggagctgcagaatcagggtgccgagctggtcgaggtcgacctgccgcacctggacgccgccatcgccgcctactacgtcatcggcccggccgaggcgttctccaacctggcccgcttcgacggcatccgctacggctaccaggaggagggctgcgccaacctgtccgaccagagctcgctttcgcgcgcccacggctttggcgccgaggccaagcgccgtcagatgctcggcgcctacctgctgagctcgggcgtgtacgacaaatactactacgccgcgcagaaggcccgcacgctcatcacgcaggactacgacgccgcgtatgccaaggtggacacgatcctgatgcccgcctcgccgcgcacggcctttaagtttggcgagatcagcgaccccacgcagatgtacctgtccgacttgtacaccatttcgcttaacatctgcggcaacggcggcatctcggtgccgctgggcctgggcgaggacagcaagctgcccgtttctgcccagctggtggggcctgcctttaaggaccgtcagctgctcacgttcgcccnnnnnnnnnntggagcgcggctttgccgatgccgccacgggtgcgcccgcgctttccgtcgcgcccgattttgccgggaagggaggcgagctgtaatgaaggagctttccgaggtcctgcaggattgggaggccgtgatcggcctggagatccacaccgagctcaccgcactcgacaccaagatgttctgcaactgcaaactcagccacgatgacgagcccaacgccaacgtgtgcccggtgtgcctgggcctgcccggcgccctgccggtgcccaacaagaaggcaatcgagagcatcgtcaaggccggtctcgccaccaactgtgagatccagcgccactcgatgttctaccgcaagcactacttctatcccgatatggccaagaacttccagaccacgcaaggtccggtcgcctttgccatgtacggccatctggacctggacgtgaccggtcgcggtgccgccgagcgccccgactgcgcgtttggcgaggccgaggcccagagcctggcgagcgcttcggccaacgccgagggcctgtccacgtccatgacgtcgaccatgcgcgagggtaaccagcgcgccggtcacctggccagctacgacgcgtccaacctgcagatgcccgagcgccgcgaggacggttcctacacggtgcccatccgcatcctgcgcatccatatggaggaggacgctgccaagatggtgcacgtgggcggtgccgagggccgcattactgccgcggccgagtcgctcgtcgactacaaccgctgcggcacgccgctcatcgagctcgtcaccgagcccgatctgcgcacgcccgaggaggcccgcctgtttatggagaagctccgccgcatctttgtgacgctgggcatttccgactgctccatggagaagggttccatgcgctgcgacggcaatgtgtcgctgcgtcgccgcggcgagaccaagctgggcaccaagaccgagctcaagaaccttaactcgttcaagagcctgcacgatggcctcgcctacgagatctgccgccaggccgaggtgctcgaggagggcggcatcatctatcaggagacccgccactgggagcccagccgcaagcgcaccgtggtcannnnnnnnnnnnnnnnnnnnnnnnnnnnnnnnnnnnnnnnnnnnnnnnnnnnnnnnnnnnnnnnnnnnnnnnnnnncgccgttcgacctggacgacgagttcatcgaccgctgccgcggcgagatccccgagctgcccgatgccaagcgcgctcgctttgaggcggactttggcattaaggccgccgatgccgagcagatcgccggcgatcccgagttcgccgagttttttgaggccgccgctgccggtatggctggcaaggaggcccagacggtcgcaaacctgctggtgaacgagatgatcgcctaccttaagggcgcaggcgtgtcgctggccgagtccggcatcgcgccggctcaggtggcagcgctggctaagctgctggcgaccgatgccatcagctccaaccaggcgcacgaggtctttgaggttgacaatgtcctgctcatattaaaaggaacgtccccaagtgccgcatcgccaacgactaccaacaacaaaaacgccgatgttttggcgcagacagacactatgacccaatccgagggcactaaaaagataggagcccccgctcgtgaccgcgggtcggggctgcgacaatgatgttgaagtgccataggcgcagccgcgccgcaacgaggttgggaggctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcttcgccccgcaaagggagctcgccgggctcggcgtcgagtgcgtcgtcgccgcggtctcgaagatccccaggtcggccgccgactcggcctccaagaacgacaggaacgacgccgccaggatggccaaggcgatactcgcccacgacatctcccccgtatgggtcccctcccccgaggtcgaaggcatcagggacctcgccggcgcctacgacggggcgaccgcgcgcctggcgaccgccaagcagcggctgctcgccttcctcgcaaagcgagggttcgtctacggcggcaccacgcccgccggcaacccgaggaagtactggacctacgacttcctgaggtggctcgacaaggtcaggccggaggacgatggcggggttcggacgctcgccgccctgaggagcgaggtcgaggccgcggcggaggcccgggcggacctgctctccgagtacagggcggccgtggatgccagcccgatcgccgcggaggcggccgccctccagtcgatcaagggctgcgccttcgcgctggccgccgccttcgcgtccgaggtcggcgacttcacgaggttccgctccggaaggcaggtcacggcctacttcggcctcgcgccgagccagaggtcgagtggcgactccgtgcggctcggaggcatcagcggcgcgggcaacgcgctcgtgaggaagctggccgttgagggttcatggtgctacgccgcggcacggcaccagccgaagctcatgccgagggacacgggcgtgcccctcgagataaggatgcacgggaggaagggnnnnnnnnnnaggggtccgagcggctcctgcggcggcgcgaggagatgctcgcccgcggcatgcccgcggcgaaggccaacgcggccaccgcggccgagctcgtgaggtggctgtgggccctcggcacgatgtgccgggagggcgcggaatagacatagcccccgtcccggcgagccgggcggccttcggggataccccctatttcgctgtgcgcgcggagccctccgcatgcgcctcgacaggcttggggaaccccgccgaaggaatggagtgcgggccgacagaacggtatccgcggatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggcggggccattgtggctcttgacagcggattgggtcatatgagcgaaagcccgccagagcgagcaaggtgccttgaagcgaggcggcattgaccttctggtcatgccgccgaagttgaaaggcagattgccgctctggcgggcttgcagcgtcggccggttacggcgtttggtaaaacgccgtaactaataatccagcttccacatgtagcggcgcgtcatgtagtccttgtgagtaacggcagagagtgcacgcatatacacgttgttgaggatcggggcaaagatcaggtggttgaagtactcgctcacgctgtccttgatgtcgttgaggccgagctccttggcgtcaagctgatagacgcgctcgccaccgtactggttgacgaagcggatgccgcgctcgtcgttgcagcggctgcggccgacgctgatgagctggaacagcgaggtacgcttgtccaggatctcgaagggaccgtggaagaagtcgcaggtgttgatggtgcaggagtcaatctgcagcatctcctgcacgttgcagatgctaaagacgtaggcggcaccaaagagcggaccctgagccatgacgttgatgcagggcttgtcggcgttctgctcggcccacttggcagcaagcggacgggtgtactcgacggccttgcgatagatggggtcgaccaagtcgaacgcggccatagcggtctcgtgctcggcatagccctcggtctgctgcgtaagctccatggcgatcatggtcacgacggcggagttggtgcggcccatgcaggactcgtcgacggccaagctgtcgtactggatcttgtagtcgcagacctcggtgaggccggactcgtcaacatagatggcgatggtgctggcgccgtggtccttggcgacctgggcggcgacgatggtctccttggtgccgcgcatggacacgacgacggccagggtgttctcgttgacgtaggccggggttgcgtgcacgaattcgttgctggtgtagctggagctcacgacctgcgtggcctcgtgctccataaagtattgagcagggtagttgccgccattggatccgccggcgccaatccacacgacgcgcttgataccgcccttgtctgccttgtcagccaaaacctgggagacgacatccttaacctgttcctgagtagcagacgagcagtgtagctctcctgtggcgatgcgtcgcgacggccgtgaatcacctcggccaggcccgtcagcgtctcaccaatatttccatcctgaacatttgcggtgcgcacacccatagttcaatcctttccgttttgccgagcgcctaacagagcgcccgccctaggcgagtttcttaaagaagcaggtacggttgccggtgtggcaagccgggcccggagagtccaccttgaccagcagcgtatcgctatcgcagtcggcccagagctccttgacctcctgcatattgccgctcgtcgcgcccttgttccagagctcctgacggctacggctccaaaaccacgtggtcccggtcttgagcgtcagccccaccgactcctcattcatccaagcaaccataagcacctcgccagtgtcatactgctgaaccacacaaggaatcagccccttggcgtcgtatgtaagctcggccgcagtcgtcacttgctccatttaaaagtccaatctcacagggattccctgactggccatatattccttcacttcgcggatgctgaaagttccaaagtgaaagacgctggctgccagcacggcgtcggcttcgccctcgattacaccctcggcaaaatgctcgagcgtgcccacgccaccgctcgcgatgacgggaatcggcaccgcacgcgccacggcgcgggtaagcgccaggtcgaagccggccttggtgccgtcgcggtccatactggtaagcagaatctcgccggcgccgcgacgagccgcttcctcggcccacgccacagcatcgatacccgtggcgttgcggcctcccgcggtgaagacctcccacttgtcggcgcccggctcgccgggcaggccgacgcgcttggcatcaatcgccacgatcacggcttggctgccaaacgccgcggcagcttggctgatcagcgacgggtcacgcacggcagcagagttgagcgacaccttgtcggcgccggccgcaaccatggtacgcatgcccgccaggtcgcggaagccgccgcccacggtatagggaatagcgagttcctcggccgcgtgcgccgccatctcgatggtcgtcgcgcggttatcgctcgtcgcggtgatgtccaaaaacacgacctcgtccgcaccctcgcggtcgtaggcacgcgccagctccaccgggtcgccagcatcgcgcaggctcacaaagttgacgcccttgaccacgcggccgtccttgacgtccaggcagggaatcacgcgtttggtaagcatgggctactcctcccctcgggcggcggccagcgcctgggccagcgtaaagttgccctcgtagagcgcgcgaccggtaatggcgccctcgatggcgtcctcgcccaccgcggcgagtgcgcggatatcgtcgagcgtcgagatgccgcccgacgccacgacgggaaagcccgcgacctgcgccacgtggcgatacgcagccacgtcgatgcccgtctgcatgccgtcgcgcgcgatgtcggtgtagaccaggtgcttaaagcccagctcgctgagctgcgccacggcatcgtcgagcgccacgcccgcgccgtcgcgccagccgttcaccttgacctggccatcgcgcgcagcgatgtctgccaccagcagctcgccaaatccgcgggccgccacctcggcaaagcccggctcggtcacgagcaccgtgcccagcgcaatgcgacgcgcgccgtagccggcaagctcgtcgatacgcgcgagcgagcgaacgccgccgcccacgtccacagacagaccgtcgacgccgcagctggccttaatcgccgccgaattggcagcgcatgcgtcctcgtcctcgccaaaagcggcggacaggtcgacaacgtgcacccagctcgcgccctgctcggcaaaggagcgggcgacggccacggggtcgtcggaatataccttgcagcggctgcgatcgccgcgctccaggcgcacgaccttgccaccgatcaaatcgattgcgggaaacaggatcatcggccggcctcctcgacgatgttgacgaagttcttaaggatgcgctgacccagcgcggaggatttctcgggatggaattggcaaccccacacgctgccgtggcgcacgatgcacgggaagctccgcgtgtagtgcgtgcgtgccaagacatcggcgacatcggcgtcgtcagccaccgcgtagctgtgggtgaagtacatgttggcgccctcggcaaagccggcgagcagcggatcggccgtaccggcgggcgtcatatgcacttggtcccagcccacgtgcggtaccttcagacggctcgattccaagcgtgtgcacgagccgcgcatgatgcccaggccatcgacccaaggaccgccagcccactcggaggcgttgccgtcggcgaccgcgccctcgtccgcaggcacgccctcgttgccgcgctcaaaaaacagctgaaggcccaggcagatgccgagcaacggagttccagcggcaacggcatcgagcacggccgcctcctcgccgctctggcgcataaaggcgatcgcgtcataaaacgcgcccacgcccgggatgaccaggccgtcggcgcggcgaatctgctccggatcgtccgacgtgcaggcggcggcaccggcgcgcgcaagcccgcgcgcaacgctcgacaagttgcccttgtggtagtcgaccaccacgattttcggttcgcccacgcgaccctcccttttcctcatccaaaacctgccaaaaagggacaggtttattttggtcggttaaacgttcacccacctaatggagagcgtatcgcccgtctcggcagccagtttgggcgccacgataatgtcgccggcataggcgtgaccgacctcggtcatgtcgcggccgcacatcacatacaggtgagccagacgatcgctcttgcgggtacgcgcgttgatcagctcaaggcccggctcaagcgtgcccgtcagcaccttgataaagctgatgcgaccctgctgcggatcggccagcgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgacgccctgctccttaatgcaatcgcccgcaaagaccggcacaaagatgcgctcggcgatcgccttcgacagcaggccttcaagctcctcctgagttagcgtctcctcgccttccaagtacttcatcatcagctcgtcgtcagcctcggccaccagctcgcacagatggtcatgggcttcctccgcctgggcacgatactcctcgggaatctccgactcaacggcttcggcgccgttgcaatggcgcgccttcatgcgcaccaggtcgatgattccgtcaaagtcctcgccctcgccccagggaagggtcacggcgcccaggcgcgtgccaaagcgctcctgcagcaggtccatggtggtcgtaaagctggcctcggagcgcgacaagcggttcacgaacaccgcacgcgccagacgcagatcctccgccgcataccaaagcttgacggtcgtaggctgcgggccggcctcggcgtcaaccacaaacagagccgtctcgcagacgctcatcgcggcaaaggcgtcgccgataaaatcggggtagcacggggcatcgagcacgttgatgcgggcacccttccagtcgattggcgcgatggtcgtcgagatggagaatgaacgcttgacctcttcggggtcatagtcgagcgtgggcttggtgccgtcgtggccgcccaggcgggcggtcttgccggaaaggtggagcatggcctcggcgagtgaagtcttgcccaccccgccttggcctacgagcaccacgttccttacgttaccggtcttgggagcacccatgatgacctccttgcagggccgcgctcaatgcgcgacgccaacggggagagttcgcggtcggtgccatcccgggagcagcatggtcggcagccgagccgactcaccctccaaatgtcctatgccaccaccctaccctcacgggcggctgtccatgcatacctttcggcgcacgtatgaatacaggcggcgagaggaagagacaagcttgtgaggcgattattgaaccccgtcgatgcaaacaaaaagccgccacagaccgtaagacctgcggcggcttcgcctcaattaatagttgagtaaatacctgagcctacccctcgatacggctcaagaactcacgggtgcgctgctcacgcggatggtcgataacctgctcggcaggaccctcctcgacaatgcggccgccatccataaagaccacgcggtcggcaacatcgcgcgcaaactgcattgcgtgggtcacgatcaccatcgtcatgttctgcgccgcaaggtctttaatgacacgcagcacctcggccgtcagctcggggtcgagcgccgaggtcggctcgtcaaagaacaggatctccgggtcgagcgctagggcgcgggcaatactcacgcgctgctgctgaccgcccgagagctcacacggcaccttgttctcgttgcccgtcagccccatttgcgcaatcagctcgtgagcgcggacttccgcctgctcgcgcggacgcttaagcacgcgaatcggcgcatcggtgatgtttttcatcacggtatagtgcgggaacaggttgtaattttggaacaccaggccgaatcgcgagcgcgcctgcttgggcacatcgcccttcgcatagaccgcgcccgaacccgcatccgtcgcaacggcaaggtcgccaaacgagagcgagcctccgtcgagtgtctcgagcagcgtggcacaccgcagcagcgtggacttgccgccacccgaaggcccgataatcgccacgacctcgccacgcttcacctcaagcgagatatccttgagcacctcattgccgccaaacgccttacgcgcgttcgatatattcattaccgaattaatcatggtagtaatccaattttttctcggcggcgcccagcagcatctcgacgacgaagttaaagacccagtagattagcgccgcgatcgcaaacggcaccatgctcacctgcgaggcgaccagcgccttggccgtcgagaacatctcacccacgccaatggcaaacgccagcgacgtgtccttgaccagcgtgatgatctcgttgcccatcgccggcaaaatgcgcttggcgacctgcggcatcacgatatacagaaacgtctgcatgcgcgagtagcccagcacctcggcggcctcatattgaccgcgcggaatcgactgcaagcccgagcgatagatctcggcaaagtagccggcgtagttgatgatgaacgccacgacgcacgccgtccacttggaatcgggagtgagcgaaatgccaaacacgtagtacggggcaaagtagatggcaaacatctgcagcatgagcggcgtgccgcgcatgaccgagatgtagatgcgcgcaatccaacgaagcggcgcgattttgctcatactccgacgtgttgaacacgaacgcacagcaggtgagcccgacgagcgggagccactgcctgagcgtgatgccgtcttgccttgcctgactcatatataacgtctccaatcattttgagcggaggcgattatatagcaacggccccgcatccgtcagcaacagatgcggggccgaaaacaattcgatacacagaggttgcgccgtcaataaataactaagccaaccccagcaatatgcccgccgaatgcacgacaaacgccacgatccaggcgaccgtcacttgaaacgcgaacacggcaacggcgtagcgcgcgcccagctcgctcttgacggcgccgatcgcagccacgcacggcgggtacagcaacgtaaagaccaggaacacataggcagtaaacggcgaaaacatggtcgacagcgccgcgggcgaggtcgcgcccaaaagtaccgtgagggtcgagatgacgctctccttggcgataagtccggtgacgagcgccgtggatgcacgccagtcgccaaacccaagcggcgtcagcgccggcgcgatgatgctgccgaggcccgcaagcaggctttgcgactgatcggcgaccacattaaagcggatatcgaacgtctgaaggaaccagatgaccacggtcgcggcaaagataatggtaaaggctttggtaataaagtccttggccttatcccatgccagcatcaccgtcgtcttgacgctcggcaggcggtaattgggaagctccatgataaacggcaccgggtcgcccttaaatgccgtacggttgagtaccaaagccgcgatgcaaccgaccgcaatgccaatcagatagagcgagaccatggcgggaactgtcgcctgcgggaaaaacgccccgcacagcagaccgtagaccggcaacttggccgaacagctcatgaacggcgtgagcataaccgtcatcttgcggtcgtgctcggatgggagcgtacgggtcgacatgatagccggcacggtgcagccaaaaccgacgagcataggcacgaagctgcggcccgacaggccaaagcgacgcaggactttgtccatgacaaaggcgacgcgcgccatgtagcccgagtcttccagaatggagaggaacaagaagagcacgacgataatcggtaggaaggtcagcacgctgcccacacccgtaagcacgccgtcgacagccagcgagcgcaccacgtcgttggtgccgaacgccttgaggcccgcatcggccgaggcgatgacggcagcgatgccgtcctccatgagtccctgcaacgccgcgccgatcacgccaaacgtcagccaaaagacgaggcccatgatcaccaggaacgccggaatggctgtgtaacgacctgtcaggatgcggtcgatcttgacggagcgcacatgctcgcggctctcgtgcggcttgacgacgcaacgcccacacacgtcgccgataaagctaaagcgcatatcggccagcgcggacaggcggtcggtgccggcctcgccctccatctgggtaatgatgtgctcgatggcatcgagctcgttgcgatccaggtgaagcgcctcggtcaccagctcgtcgccctcaaccagcttggtcgccgcaaaacgcacgggaatgtgcgccgtcgcggcatggtcctcgataaggttggcgatgccgtggatgcagcgatgcagtgcgccgccgtctgggccatcaggtgcgcagaagtccaggcggccgggacgctcgcggaaacgcgccacatgcaaggcatggtccaccagctcgccgataccctcgttgcgggcagcgctaatggggacgaccggcactcccaacaggctctcgagcaggttgacgtccacggcgccgccgttggccgtcacctcgtccatcatgttgagcgcgatgaccatgggacgatcgagctccataagctgcagcgtcannnnnnnnnnnnnnnnnnnnnnttacgctcgatgttggtggcgtcgatgatgtcgatgatggcgtcggggtcttcgtccaagatgaattggcggctgacgatttcttcgcccgtgtacggcgacaacgagtaaataccgggcaagtcggtaacgctcgcctcggggtggttacggatagtgccgtccttgcggtcgaccgtcacgccgggaaagttaccgacatgctggttggagcccgtcagctggttgaataacgtggtcttgccgcagttttggttgccggcgagggcaaagtgcagcggcgcgccctcgggcacggccgtctttgccgcacggggcgaatacgtcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcgagcggcatcgtccgtgcgcagtgtcaactcgtagccacgcaggcggatctcgagcgggtcgcccatgggggcgtacttcatcatggtgacttcggtgcccggcgttaggcccatgtccaaaatatgctgtcggagtgcctgatcgtccgatgccaccgatgcgacaacggcgtcctttccaatctcgagtgtatcgagcttcacgcgctcatcctttcgttagacgcggttaaccgtttaccggggctaaccaactcgtaacgacaaatgatagcgctctgaactattttataaagtcaaataccgatgtttacctgcgcaaactttatgcggtgcgccccgaaagctctttggcgccgagaccaccgacggtcacgacggtcgccgccgtctggtcgccggtattggggatcgccgaaccgttcttcttgctgccctgggccttgtcgcctgcgggcttgcccgcctggttgccgccgttcgagccattgccggaaccctggttgcccgagccgccctggttgccggagtcggcatccctgaggctctcaatggccagcttgagctggtcataggccgcctggagctgggtgtcggaagcattctcatcacccaagacgtcctcggcgtaggtaatggcatccgtcagggccttgacagactcgtccgtcttgcccctggtgtcagtctccttcgcctgcttgaccagggccttgagctgcttcttagtcggattctcgaccgggaccaccggggtcttctcgagcgcgccgcgggcgctctcgagcgccctgagcgcctggtcgacctcgtcctgcgtggcgtcctcatcgctcaagatggcgcgggcgctcgccagggcgtnnnnnnnnnnnnnnnnnnnnnnnnnnnnnnnnnnnnnnnnnnnnnnnnnnnnnnnnnncatccttcgccaccggatcggggacggccgtaccgtagaacttgagctccgccatgctgcagtaggcatcaacgtcgccaccgccggcgtgaatcaccttgacggtcacgtagcgaccgcgcgcggcgccaaagctcatctgcttccagtcgccacggtcggtgagcacgcggccgtcgttgtcgaaggcgaacgtacccatcgacgcggcggtgcccatctcataaccgtcggcagtgtcggagaccagtatctcggcctcgaagatatcgccgttagtgccgccgtcctggcgcggcaggaatgtaacgtcggtgagatcgtagtcgcggcccaggtcgacactcagatactggggcataccggtcccatgggcccagtcgctgtgccaaagcgtccgctcgtcgccgtcgagagcgttgacggcgttgctgccctcgtagtcggcctcactcgagaagtcggccaccttgacgttcttgcggttctcgggcgtgttgatgaggatcttctcatcgacagggcgcatcttgaggccgtcgattgccttctcgatcttggcagtggcgtctgcgacatccttcttgctatagctgccctggccgctgtcgaggagcttccgagccgcctcgaccgcagtggtgagagctgcataggaatccttggtgtagacggactcgctgtagcccgcggccttggaaagcgctgccacgagcgcagaggtatcgacaccagccttgacctcgacctcataggatgcggtcttggaggggtcgagtaccgacgccaccgtgatctttgccttgccggccttgttggcacgcaggtagtagctcacgctatcgccagcctgaacagcggagacgcttaccacagaggggtcggagctctcgaccgtcacataggggtagccagcgctctcaggcgtagccttggcgtcgacgggcgtaatgtcgccttcaaagaactcggtctggttcttgcctagctcgacaccctcgatggcctcgacaccctgcgtgtagttgaagttgacctcacgcagtgtgagcatctggtcacccgatgcctcaagcggcgtgacctcgaccttagtcaccttcttgcccttgttctcggcagagaggtcaaaggcgtagcgagccaggaaggaatcgtactccccgcccgcgaactcttggatcgagccatcctcgaacgtcacgacggccttgatcttctgtacggttccgttgccgccgttgcggttaacgacctcgacgctatcgagtttcgacggcgtcttaaatgcgaatgtcatcgtggtgggaagcttcacgtaactcggtagcttaccctcgctgtcccagttgccactccagttccacaggaactcaaagccgttgtcgccctcgttattatcgaacagcgcgttatagctcttctgctggataagtttctcgacgttggtcccgtcgtcggtcgtgagctcatcgttggtcatcgtgatgttgaaggcatcctgggcgtactcggcgaccgttggctgaggaacgtccggcatcgtcaccgtgccgtcgctcgcaaactcaagtgcgtcgcatgccgggccgataagccaagatgtcgagggcagttcgacctttccggcggtcttggccttgagcttgaaactcgccaccgcgccagtaccgttgtagagcttgccatcgccgcggttggcaaaggcgagattgatagtctgcgttccgtccacgaactggaccttctcgcgagacaggttctccatgccggcagtcgagccgtcctgcgcgatgctctcggacacaaactcgaactggtcgctcttgaagttgacgagggcgcccagggcgttgacgttcttggcgtcggccgcatagacatcaacggtgatctcatcaccggcctcgacctcggtcttgctcggaatcaccgcgagcgaacctgcgaccttgcccttttgtttagtgccgccgtcaagacccgccatggtgaacgagtaatcgtagacgtcgtaaacgccgttatcgttgaggtcggcgaagtggtcgcggatctgcgaaccgaacgtcggggtatcgggctcgcgattctcgaggcccagatagttcttcatgttggagtagtctccgtcggagatcgtggccttgttgaggttggagcccacggcgaagccatccgtgctttgccggcaagctcatcatggacgctggcctgcgcggccacgccatcggcggcgcgcaggtgagcgagaagcactgcggcttcatcgtcaacgccgaccgcgccaccgccgccgacgtcgacgaactcatccgccacatccaaacaaccgttaaggaccagttcggcgtagacctagaacccgaagtccaccgagtaggcgaatttatttaaaaaaagaaggccccgaaaggggccttcgccatatttattcagctaacccagtccggagcgaagcgcaccggacccgagaggtcagcggctgtccgaaaggnnnnnnnnnnnnnnnnnnnnnnnntttcggacagccgcggaccaacggtcgttaagccccgctacgacagcgcaacgccgccaagccagccccagcgcacgccagagcccgtaccgtagaagctaataaacgaatcaagcgacttagacgtaatggcaccctcgttgctcataacgatgccgccgccaacgtagatgcccacgtggccgtagatcaggcccggagcaccagtgccgctgtgcgaggagtcggccacgatcatgccaacctgcagcgccgagcgatcggagctgtagcaccaggcgttgaacatgtcgcacgcgttgccgccaaagtagcccacgccggcattacggaagacgttggtaacccaagcagcgcaccagccctgaccaggcgaaggcgtggagtagcatgcgttgacgacagcctgctgcttgcccgagccgcccgtctgctgcggagtgccaccggcatacgagccgccacccgagctcgaaccgcccgaagaagaaccagtattcgcagaggctgcggcagccgcagccgccttcctggcagcctcctcggcctgggcggcagcgaggatctcggaatcacgctgggccatgagctccttgacatcgtcggaaagaccgttcagcacggtctggacctcttgctgcttggcctgcatatcctgcatctgggccgtctgctgatccttgagtttctccaggttggccttttgtgcttcgagctcggtcttctgcgcgtcgagctcagcctgaatcgtctggatatcctcgatggcatcgcggtcgctcttgttgatcttctcgacgtagtgcgcgttggcgacgagttcctcaaacgagccagaggccagcagcagcgacaggatgttcgtaccgccggacttgtagctggcggccacgcgatcggaaaggtcgttgcgcttcttcttgagctcggccttcttttcatcgatctgggcctgcgtgtcgtcaatcttgccctggacattctcgatgtcgttgagggtctgggcattcttgttggccagcgccgcatactcatttgcgatgctgtcgagctgggcctgaacctcgtcgagctgggcctgggcggcattcaatttatcggtggtttctttggaagcctccgccgcatgggcgcgagtgggcaggccaaaaagaactgccgcagaagcggcgccgaacagggccttaagggcagtgcggcgcgagagctcctgggaaaggatggaatcgctgtttggtgacatatgtactccgttacatgcttatttatatgtcgctcaactcatacatattagcgtacatatggcgcgtcccaacgatttccacgaacggcaggaaactacaaggtcggcggctcgtaagcaattgtcaaatttgaggtaacaattaagcaagctcttatatgagtacgttaacataatcctctgcttttcctacagtgcaccatttgggcgtccccgcctgcgctatactcccctctagaagtgttcctgattcgataggagactacatgtccaaagcactcgaccccaaagacacctgcgtcctcgttaccggtggcgccggctttatcggctcgcacaccgtcgttcagctgctcgagggtggctaccaggtcgtcatcgtcgatgatctctccaactccagcgccgtcgccgtcgaccgcgtcaagaccatcgtgggcgacggggccgccaagaacctcaccttctacgaggccaacgtgctcgaccgcgatgcgatgaacaagatcttcgatacccatcagatcgaccgtgtcatccactttgccggctttaaggccgtcggcgagtcggtgagcaagcccgtcgagtactaccacaacaacatcgagaacaccctggtgctcatcgacgtcatgcgcaaccatggctgcaagtccatcatcttctcgagctcctcgaccgtctacggcgacccggacaacccgcccgtcaccgaggaagaccccaagaagcccgcaaccaacccctatggctggaccaagtggatgatcgagcagatccttatggacgtccacaccgccgaccccgagtgggacgtcgtgctgctccgttacttcaaccccatcggcgctcatccgtcgggcctgatcggcgaggaccccaagggcatccccaacaacctggtgccctatgtcgcccaggtcgccgtgggcaagctcgaggccgttcaggtctttggcaacgactaccccacccccgacggcaccggcgtgcgcgactacatccacgtgtgcgatctggcctctggtcacgttgccgcccttaactggatgaacggcaagaccggcgtcgagatctttaacctgggcaccggcaccggcacctcggtactcgaggtcgtcgccgccttctccaaggcttgtggcaaggagctgccctacgtgatccgatgtggtagtagaacgtgccgtcctgctcaaagccgcgctcatagaggccgctcgtcacaagggagcggttgcgcgtcttgaccgtggcgagcacgtcgtcctgcgcgccgttggggtcttgcacgcccacgttccaggcgtcgccgtcaaagcttttgcccatcacgtagacgttgccgcccaggctgatggaagcatctctgacgccgctcttcttaaagagcgccacgaggtcgtcggtgatgtagcccttggcgataccacccaagtcgagcttggcctcggggtcggagagggtgacggtggtaccgtcgaccgtgatggtgcgatagtcgacatggggcagtgccgcctggatgtcctcatctgcgggcttgacctcgttgtcaaaatcccagaggctcgagacggcgccgatggtgatgtcaaagagcccgtcggactcctcggcgtagcggatggctgcttcgatgacctcggcggtctcgtgcgcgacttccacgggcttgccgcctgcattgttgatgttccagatatccgagccctccacggtgcgcgagaacttgttctcaaagtaggtgcagcggtcggcgacctcgtccatgacctttttgctgcattgggcgctgatattcacgacagtgtcgaagacaaagagcgtcgtgctctgcaccttgggcgagctgtcggagcccgcggagcccgctttggacgcggttacagagcccgagtcgccctgcgtgcccgagcagccggtaagtgcaccggcgcaagagacgagggccccgcctgcgagggcgataaacgtgcggcggtcgatggtgtggggggtctggatcatggtgagctttctggtcggtggcgttacggatgagcctgcgcctgcacgactcggtgttgacggggtgccgggccgcgggtgcgcgtgccctacatgagcaggtagcagagcgcggcgaggatggcagccttgacgagcgtgagcgcaacctcggtcccgcgaatggcgggccctgcgggcgggcgcttgcgggtgttgctctgcgcgagctcgctggcatcgtcggttgcttgatcgcgcttaaagccgtcgagccgggcgagcgtcacgttggccatggggcagccatcggcgcagcgcccgcaggcgatgcactcgcccgattgcaggtcggcgcgctcggggtggatgcgtaccgggcagctgtcctggcagcggttgcaaccgcgcgcacagctttcgcggcggcggttgaaaagcgagatcggcaacaccggcagcagcgagaatatggcgccgaaggggcagaggaactggcagaagaaacgctcgacaaaggccatcccaaccatgaccgcgccaagcgcggcaaaggccgtgggcgcgatgccctcgagcgagcgcgcagtgatgccggcgaaggcgacccaggggctcgcgcccgagacctggggccagatacccatcacgcagagggcgcagatgcccacgaggacggcgtacttgacgagctggagcgcgtgctgcacgcccgcggggagccggtgcgcgcccttgccctcaaggcggagtgtccggcgcagcggggttgcaagcgcgtagacgatatcgccgagcgtaccgaaggcgcaggcaaagccgcagaagaaacggccgaacacgcaggtgaaggccaagagggccaaaagcagggataaaaagccggtgagctcgatgggtgcatggctcccgagctgcgtgaagatgtacttgacgccgttgaaggcggcgttccaggcggccgggaagcagatgagaaagccgaactgtacgcaccagcgcacaccgcgatggaggtactgtcggcgcaggcgctcctgcatcttgttcttggggtgcgcgatgacgtttgcgccgttgcgcaggctttcaagggttcccgcggggcgctttgcgccgcgggtcttggtggatgcagtcctggccattactgcgtacctccggcgttgctctgctcaagcgccgcgttgacggcgtttaggatgccggcactcgagaacgtggcacccgagacggtgtcgacgttggttccctgggcatcgcagatggtctgcgtgaggccctcggcctgcgcaaagtaggcgggggtctcgccggcgtggtccgtgacctcgacgctttcgatgtatccgttctcgatggtcacgcggcaggtgacagtgccgccgtagccctgggcgctgccctcgaaggtgccgtcggtgtcgtaggcgccgcgcgtctgcgagcgctcggcctggacagcctccgcctgggtgcgggcgtcggcctctgccgcctgggcggcccagctgctgtagcccgctacgatggcgacgacggccgcggcgttgacggctttgagatagaaattgcggttgcgccagaggtggcgcccaaggagggcaaacgggttannnnnnnnnnttacgcatgggcgccagcctcctcggtggccccgtttgcggcggtcgggttggccgtaggctcatcgggggcgtttgtcttgtcagaagcgtctgccttgtcgcctttgctgtcgttcgcgttcttataagccgcggccgagcgcgcgagggcgtcggtgtaggcgttggcgatggcgcggctggagtaggtggcgcgcgccaccacgtcgatcttgccagcctcggtgcccgcgagcagctgctcggggatgccggtgtagacggtaccgcggaaggtgcggctaccggcggatcggccacggccacacgcgcgatggcgagcagctggcgttggccctgtgacaggttggcgccgtccgccgtgaccggcgtgtcgtagccttgtggcaggcggcggataaacgagtcggcgcaggcggcctcggcggcagcacgaacctcctcgtcggtcgcgtcgagcttgccaaagcggatattctgcgcaatggtgccgctaaacaggtgcgtatcctgcagcacaatgccgagcgacccgcgcaggctggccttggcgatatgcttgacgtcgatgccgtcgtacgtgatctcgccgtcatcgacctcgtagaagcggttgnnnnnnnnnnnnnnnnnnnnnnnnnnnnnnnnnnnnnnnnnnnnnnnnnnnnnnnnnnnnnnnnnnnnnnnnnnnnnnnnaaaagtccacggcatggaagcgtacgtcgccggcaagcggcaccaacccggtcacaagttcggtgccgtcggcagccaccgcgcgacccgcatcgtcgaccgaggccacgtcgtgcagatgcccgtacgcgcccacgccacggccctcgggaatcttccacgcccacgcggactcgcccgtctgcaccagctccacgcagccctcgtccacctcgggctcaaggtccatcgcggcaaacaggcgctcggcaccggccagcgcgttgagcaagaagttgcccagctgcgtaaactggttgatgggcatggccgcctggcgcacaaagaccaggtagctcgcgagcgctcccacgtcggccaggccgttgatgcagagcatgccgcccgccaccgcaacgatggcgtagttggcatacccgatcaccacggtcatgggcaccatcgagttggcgtaggcctgcgcggcgccaccggtgcggcgcagctcatggttgcgcgcgtcaaaaccggcaacgttggcctgctcgtggttgaagaccttgatgaccttttgacccgacaccatctcctcgacatatccgtctaggtcgccgagcgatgcctgctgggcnnnnnnnnnnnnnnnnnnnnnnnnnnnnnnnnnnnnnntgatgagcatagccgtggtgccgatcacctggattgtcgcctggatcacgttggcaaagctgttgttgagcgcctcggagaccgtgtcgacgtcgttggtgaaaaagctcatgatgtcgcccgagcgcgtgccgtcgaagtagctgagcggcagcgtctggatgtgcgcgaacaggtcgcggcgaatgtcggacaccacgcactgggctgcgcgcaccatgatctgcgagtagcccagggccgacagcacgcccgcggcatagatggcagccgtaaagagaacctgcttggcgagcagctcctccccgcccgtagccaggccgttgacgatggggcgcaccatataggtgccggcaaggctcgcgatggcggcgatagaagcgagcacacctaccgcaagcagcgagaacttggcgtggcccatatagctgagcaggcggcggagcgtctgccctagattggccgggcgggcctgagcggatgttttaggcatggcgctcacccccttctcgggccagggcatctgcggtcgtatcccccgcgaactccatctgcgaggcataaatctcctggtagatgttgtcacccgccagcagttcctcatgcgtgcccacaccgtgaacacgcccgtcgtccagaaccacaatgcgatcagcgtccatcacgctcgcgatgcgctgggcgatgatgatcacggtcgtatcgggaatctgcgcgatatgctcgcggatcttggcgtcggtcgccatatcgaccgcactggtcgagtcgtcaaaaatgagcacgcgcggatgcttgagcagcgtgcgcgcgatgcacaggcgctgcttctgcccgcccgaaacaccggcgccgccctggcccagctcgccgtcgagcccgccgatgcggtccaggaactcgtctacacacgccgcacggcaggcacgtagcagctcctcgtcggtggcatcgggcgcgccccactgcaggttctcgcgcacggtgcccgtaaacagcacgttcttttgcagcacaatgcccacggcatcgcgcagggcggccaggtcgtagtcacgcacgtcgcgcccgcccacgagcacgtcaccctcggtcgcgtcgtacagacgcgcgatgagctgcacgagcgagctcttgcccgagcccgtgccgccgagcacgcccaccgtggagcccgactcgatgcgaaggtcgatatgctcgagcacgtcctcggcagcatccgcgcggtacttaaacgacacgtcgcggaactcaatgcttccgtcggcggcctcgcgcacagccacgtctgccgcgggcgcctggatgagcgactgctcgtcgatcacccgcgagatgcgctccacgctggcaagcgcgcgcgtgagcagcaaaaacacgttggaaatcatcatgagcgagttcatgatcagcagcacgtagctcataaagcccgtgagcgagcccacacctagctcaccggcaataatcatgcgcccgccgatccacaggatggagatggcggccacgtacatcgacagctgaaacaccggcaggttgagcacggcattgccgaaagtcttcgtcgccgtgtgcgcgagctcggtattgacggtagcagcttctcgagcgagccctgcgtgatgacggccatggcgcggttccagaagagcgaggaggcgacgcccacggcatagatgcagccgagggtagtcacaagcttcagaatcttgggctgcgcggccgtccagtcgcccgactgccacgattcgctaatgacctgcagcgcgctctggaggaacgtcgcaccgatggagttgatgacggcgcagagcaccacgccggcgacgacgaggggcaaaagcaccggatagaagccaaagagcatcttgatcaggcgcgtcatggtgccgcccttgcggttgcgcgctcgctcggcggtagcggccttactcatgtgcctcgcctccttcctgggtctgggcttgcggtgcggatgcctcggtgtcggcctcgacggctccttcgccctcggcagacatcttgttttgcgaggtaaaggtctcgcggtagatctcgcttgtcttgagcagctcgtcatggttgccgatctgcgcgatacggccgccctccatgacgatgatgcggtctgcgtcctgcacggagctaatgcgctgggcgatgatgagcttggtcgtgttgggcagatagcttgccaaccctgcgcggatcttggcgtcggtcttggtgtcgacagcgctggtggagtcgtccaggatcaagatcttggggcgacgcagcagggcacgcgcaatgcacaggcgctgcttctgaccgccggaaacattggagccgccctgctcgatccaggtgtcatagcccttggggaagccatcgacaaactcatcggcgcaggccagatgtgccgcctcgcggacttcctcgtcggtggcgttcgggtcgccccagcgcaggttctcggcaatggtgccgctaaacagcacgtttttctgtagcaccatggccacttggtggcgcagggcgtccagctcgtagtcgcgcacgtccatgccgcccacgcgcacggtgccttcggtggcgtcgtacagacgggcgatgaggtttacaagcgtggacttggccgagccggtaccgccgatgatgccgatggtctcgccgctcttaatgtgcaggtcgatatcgtcgagcgcctggcgcttcgcatgcgcggaatacttaaagctcacgtggtcaaagtcgatggaaccgtcgacaacctcgagcacgggctcggcgggattggcgatcgtgggctcggcggccagcacctcggtaatgcggtgcgccgattcgtcggccatggtcaccatgacaaagatcatcgacagctgcatcaggctcatgaggatctggaagccataggtaaagatcgaggagagctggcccacgtcgaacagcgtgccctggctcgtgatgatgagcttggagcccaggtagatgatgacgacaaacgcgccgttgacgcagatattcatcatggggttgttgaaggcgagcagcttctcggcgcgggtgaagtccatctggacgtcgcgcgcggcggtggcgaacttctccttctcaaagtcttcgcgcacatagctcttgaccacgcgcatgccggtgacgttttcctcgacggactcgttgagcgcgtcgtacttgtggaacacgcgggcaaagatcgggcgcaccttatagatgatgaagaacaggccaaagcccagcagcggaataatgaccaggtagaccatagcgacgctgccgcccatggcgtaggccatggtaaaggcaaagaccagcaccagcggcgagcgcacggcgatgcggatgagcatcataaaggcctgctgcacgttgttgatgtcggtggtgaggcgggtgacgagcgaggagctcgagaactcgtcgatgttggcaaagctgaacgtctggatcttgtagaacaggtcgcggcgcaggttcttggcaaagccgcagctggcatggctgcaggtgatgccggccgcggcgccaaaagcgagcgacgtcagcgcgatgatcaccagaaaaccggcggtaggcagcatctcggcaacggcggcgccgtctttgatggcgtcgatcatgtcggcggtgataaacgggatcagcatctcgcagattacctcgccaagcacgagcagcggcgtggcgatcgtgaccttcttgtaatcgcggatgctgcccataagggttttaatcatccagttcctcccaggttacgcggattttctcgagcatctcggcgagctgctcgcgctcgtcgtgggtgagggcgctaaaggcctgctccctaaagcggatgcgcgaggcttggtcgatgcgggccttctcccagccgatctcggtcaggcgaatggtgagctgccggcgatctttggggttacggctgcgctcgatgatgccggcgcactcgagcttggacaagatttcggaaagcgaccccggcttgaggtcgaagtgcatgccgagctcctgctgcgacatttcgccgttttcctgcttggcgagcaggcagacgatgggtgccttgccggatacgccgccgccgtgaaagtgcatgtagtggccacaaaagcccaggccgctcaggatgcgtttggcgagcctgtcttcgccgttaactgcttcgggcacgtctgccggctgcgacgggtcgccgccgggctcgtgcggacgaaggttaaggggttcatcgggggcgcgacggcgtgccctatgacgcgtggattgcgcgcgggcttatgcggacgtgcgaaacgcccatcatggacaagcgcgacgttctggattgggtggccgaggttcaggacaagtacggcatctatgccgtctcttgcggctacgacccgtggcacatgcgcgacgtgccgaccgtggaagcatacgaagactatttcggtgccgacaacctgcaaaaggtcattcagggcgcgcaaacgctgtcaatgccgatgaaggagcttcgagcgctctataaggaagggcgcatcgtggacaacgccaacccgattgccgaatggtgccgctcgaacgtcgccattcgaaccgacgtgaacggataggagcgcaacagcagaccatagnnnnnnnnnnnnnnnnnnnnnnnnnnnnnnnnnnnnnnnnnnnnnnnnnnnnnnnnnnnnnnnnnnnttcattgcgatgaagaacattgcggacgattaccgcgcgatgataggaggttagagttgagcagatcacaaccgtttctgcgctcgctcttcgatgcggtgttccaccgtccgcagatgcaagcggtaaacggctatttctccacgttcacggcctatgccccgtcgttcacgacgtggcagggcgggctttacgaagcagagcttacgcgaagcatcatcgagagcggcgcagaccacgcaagcaagctgaaaccggaggtttccggctctgctcagcctgtcgccgcgcgtgctctcaggcagcagcctaacccgtggatgaccacgccgcagttcatcaagcgcatttggacgattcttcaggtcaacgacacggcgcttatcgtgcctatcgacgctggcgacggtattacgatcaccgggtactatcccgtgctgccgagccagtgcgaagcatacgacgttgacggcgagctttggctgaagctcacgttcccgacaggcgacagcgtgcttgtcgagtggtcgcgcgtcggcgtgatgacgcgccaccagtaccaaagcgatttgttcggcgacggcacgaacgttcttcagccgacgctagagcttatgcacgctcagaacgaagccgagcagtcggctatcaatcagggcgcagcaattcgcttcatcggcaagctgagccagaaccgaaacgaaggcgaccaagagcgggcgcgaaaggcgttcaacgctcagctttccgctgacaacgcgggcggaatcgcggtctatgacaagctgttttctgacgttgagcagatcacgccgacaagctacacggtcgatgcggcgcagatggagcgaatcgagaagagcgcttaccgcttcttcggctccaatgaggatatcgtcacgaactgcgcggacgaagacaccttcaacagctactacgaaggacgcatcgagccgttcgctgttcagctcggcttcgttatcacctccatgacgtacacggcgaacgagatagcgcacggaaactcaatcatgttcagcgcgaaccgcctagagttcgccagcaacacgacgaagcttaacgtttccgtcgcgcttttcgaccgtggtatctggaacggcaatcaggtagccgatgttttccaatccccgcactacgagggcggagagcgccacgtgatacgcggcgagtacatcgacctagaacttatcagcgagcatacggcggaacaggcggcgcaagccgcagagacgaacgcgaatatagccgcaatcgacgcgagcagcggctacggcgacaagaaggaggtagacgatgccagcgaaaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacccatacgttctgttcgaggatttcgacggcacaaaatacatcgaggttatcagccccgatgccttccgcgaagcggacatgagcgacgttatccttcagttcgaccatgcgggcagagtgtacgcccgcatgagcaacgggacgctcattgtggagccggacgagcacgggcttttcatcgccgccgacctgtcgcgctctcagggcgcgcgcgatctcttcgaagagataaaggccggtcttatcacgcgcatgtcatgggctttcacggtagcggcagacgaatacgaccgcgagacgcataccacgaccattacgcgcgtcaaaaaggttttcgacgtgtccgccgtcagtcttccggctgacccgaacactgagatatcagcaagaaacctgctcaacggagcgattgagcagtcgcgcaaggagcttgcgcgccgtaagagtgcccttgccgttgcgagggcgacactggcaatcgccaagagcagaaaggtttagaacaatggacgaaatgactatggatgacctgcttaacgagcttcagggtcttgtcgataagtacaaggccgatgacggcaccgacaccgagccgaccgagcaggacgcagagcgcatgagcgcgcttaccgccgagatcgagaagcgcaacgccgccgccgctcagcgccgcgacagccacaccgcgaccgttgcagccgcgcgcgccgctatcgagaacggcaccgcccttacggtcgacctgaccaagctcatgaagcgtttcagcgcgaaggagctggaggccaagcaggtgaagttcgccatgagcgtggccgaggacatgaacgcgttcacgccagaggacaccaagcgcatgcacaactccatgcaggccgcctccgacttcaggcagggcctcgtcatatgggacgccgactacgccgcctacgtgcgcgacctgcccgacagctccatcaagcacggcaagaacccgagggccaaggccgactggccgaaggccgcgaaggaagcgcacggcgaggactgggagcgcctggccgtcgacctcctgaccgagggggcgtgacatggccccggacgtgatggaggcggcgaaggccgccatagaggccctgggctacggcccggtgctcctcacccgcctggcagcatcgcgcggccacgacgacgcggtggtgctgaggcccatgcccacggccgacgcggtgcgccacatggacggcacccgccgtgtcggatacgtgctgcaggtcatcgtgaaggacacctccgaggccaaggccatgggcgacgcctacgacctggccgacgcgttggacggggccgacctgtcctcgcccaccggctcctacggcttcaccagcgcggcgctgtacacagagccgcaggagataacgccgccggagggcgggccgtacctgtgggagttccgaatcaaagcgaccataaccatagagaagggataacgatggcaaagaaccaagacctgggcttcgcgcccaactatatgagcgcgctggagatcgacaccacgccagacgcggccagccccacgtgggccatcttctcgcgcggcatcaccgaggtgaagccgaccaccaacgagaccaccgagaccaaggactactacgacggctacggcactcccaccgacaaggtgaagagcgtgcagccgcagtacgaggtcacaggcgaccgctgctacggcgaccccgcgcaggacttcgttgccagcctggcgcttgagaccggcgagggccgcacgggccacttccgccacaccgaccccaacggcgacgtggtggagggcgactgcacctacctgggcttgaccgtcggctcgcagcagggcgcggcgtccgaccccggcgcgttctcctgcacaatctcgggcgctggcgctatgcgctacatccccgccaacaagctcaagcagcccacgggcgtcacctgcaccgcgccgaccggcccggccgtgggcaagtccatgaagctcgcgccgaccgtcacgcccgccgaggcgaacgccaagtgcttcttcgcatcgggcaacaccgacgtggccaccgtcgacagcgacggcaacgtgacgggcgtggccgcaggcgaggcggtcatcaccgtgcgctgcgcgtccaagccgagcatctgcacgcaggtgaaggtcaccgtggcggcgaagtagccgcaggcgacaccagacataacctcctggacatgggggcgcgggctagtgagcggcccgcgccccttttctatgcccgacgctcaccgctcacgaaaggggcaacaaatggagcttctgaaaaacatccgcgcgtacgaggacgtgttcttcgaggaccccgaggagaaccccgacacgccgcgcttccgcgtgtggttcgacgacaagcacatcgaggagtacctggccaaggtcggcaacgccatcgaccgcgcgcaggccaacgagcagatggcccgcgaggccgacacccccgagaaggcggccgaggccaacgccgcgcaggcccgcctcatgaagcgcaccatctcggcgttcatcggcaccgagggctgggagcagctgctcgcgtggatgggcggcgacgagggccccatcgcgcccgaggagaacatccgcatcctgggcgaggtcttcgccacgttcctcaacatgttggcgcgccacgcgaccagcgagcagctgatggcgtgcggccttgcatacagcgagcgcgccgatcaggtccaggcgctcaaccgcgcccagcgccgcgccaaggccaagcgcaagaagaagggcggcaagtaatgctgccagccgcgctcacggccgagcgggtgcggctgcccgacggcacgagcgccacgcgctacccgtggaacggcgaggaggtgctggtgcgcgacgacgcgctcacgatcatccgcgtcatcgaggtgctgaccgacgagggcaagtccgacgaccagcgccgggacgagttcctggcgctgttcttcgtggactgggcggacgcgtggtgcgcatgcgactacgacgccgccgagttcgtgcggatgcgcgacgcggcggtatgggacatgtgcggactcgacctgaccggcgaccgcccgcacgagaccccgctgtgggacttggaggaggacgcggcgcgcatacgcaccagcttccgccaggcctacggcatcgagtgggacgaggtgcgcggtcgcatcagctttgccgagttcgtggcactcgtgggcggctgcccgcaggacacgccgctcggcgcggccatccactaccgcaacccggcgaccaagccgaagccaaccaaatacaatgatggtcgccggattggagttgaccaggatgacctcaaagccatcctccttgagcaccttgcaggcctgtgcgccggagtagtcgaactcacaggcctggccaatgacgatagggcccgaaccaataacgaggatgcgcttgatgtcagtacgtttaggcatgttagttctcctcggtcgcagcgttctcggactcggcgaaattccagccggcgaggcggtccttcgcggtgtcgatgtccaggtagttctcctcgccgtctatgagtcgcgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagcgctcgttcatcacgaccggcgcgataccgcggcgcacccaggcgcgcaggtcgccatcggccgcatgctcggtttcgccgccggaaagctccggaatcagtttgcccagactggggaacagcaggccaaagccgtggttttgcgcggtgatctccacgcgacggctcaccagattcataaccggctggttaccgccacggtgaccgaatttaagcttttccatttgggcgccgcaggccaagctgatcatctggtgacctaggcaaataccaaagaccggcaccttgccgatcagctgctgcacctgctcgtaggtctccaccacggcatcggggtcgccggggccgttggacaaaaagacgccatcaggattcatgtcgagcacctgctgggcgggcgtatcccacggcacgacggtgaggtcgcagccggcacggaccaggccctccagaataccgcgcttcacaccgcagtcgtaggcgaccactttgtgacgggcaggagcggcagccgcaagcgcaaagccatgcgtggcaggcaggtcggcggccacaaactcgtgaggcacgggacagctcacggtcttgaccaggttctcgcccaccagcgtgggcgctgcgtccagacgctcggcgagctcgtcgacgtcgaagatctctgtcgagataatgcccatcttggaaccattgtcgcgcagatggcgcaccagagcgcgggtgtcgacaccctcgatagcgacgatgccgtgagcgcgcaggtactccggcacgctgacggccgagcgccagttagaaggcgtggcgcacatgtcgcgaacgatcatgccgcgcatagccggagcgctcgcagggcgcacggcgtcgccggggaaggccgactggacatcggtctcgtcgataccgtaattgccgatctgcggataggtcatggttacaatttggccggcataactcgggtcggtcatgacctcaaagtagccctcaagcgaggtgttgaagcagacttcgccggtcgcggtgccctcggcgccgcatgcacgtccataaaaaatggtcccatcctcaagatacaggatacagggaccgcaggtgcccttgctggttttggccagcatacgctggcaaagctcgctgggcgcgaaggtgcgggcggcagcgcccgcggtatggttgttcgccataattctccttcccggtctcacaggaccggcttaaaggtgtgtagttnnnnnnnnnnnnnnnnnnnnnnnnnnnnnnnnnnnnnnnnnnnnnnnnttaggcctcgcggtattgtaaccgcaagcatgcctcatggcgttaatttcatcgaaatgtttacgaaatgataattatgactttctatgcataatgatttttctgggacggggattaaaaatcatcccgcggggcttgtggctcacacgggatgatggcgtcttattttttcttgtcctgttccagcagatcggacggtgaacgatcgggcttgccgccgcggaaaatctcgcggccatgcagacgatgctccaggtcacgttcggccttttcctcgtcaatcttggtctggctcaccacctggtcctcgatcagcgacgaaaccgagttcacctgtttttgaatgcgctcggcaatggtgtcgtccatgcttacgatgcgcatcttccagtcgatactcgtggcgttggatgagctcttggtccacacaaacgtcaaaatggcgctctgatgaccccgcgcggggaacatgccaaaaaaggaatcgtgctgaatgttgctatcctcgtcgatataggcgtgaacgttatacaccacgcggtcaatcttgtcgttgagcagggcgttggtcgcaagcgccgcggcctggatctgcccgttggacagcagctcgagctcattggcagacgatgtgtccaacaccgtcacctcgaccgtgcccgtacgctcatcagcttcatcgacggtaaagtcgagcgggaactgcgtaaagccgttgccccactcaaggccgcccttgagcgcggtcgagacggtatccaccgaaacgctctcggacaggttggcggtattcagacggcgcatcacgccgtagccgatctgcatgcccacgatcagcaccagaatatgttgccgcggcccacatggcccatgtcggagtagagcgcctcggcaccggtggtggcgagaaagcagctgcccagaatcatgatgcccgcgtggttgttggggctcagcaaaaaggcgatgccgcgcaccgggttgaggcacagcagcacggcgggatgctggaagacaaagaacagacccgtgccgcccaggaacaggaaccacagcgtcatgagcgggccgaacagcttaccgatcgacgaggtaccggcgcgctgcatggcaaataggccgcagataatgatgatggtgatgatgatgacgttggtctggccgtcgcccaacacggcatggaccgcgggaatggtgcgcaggccctcgatagccgtggtcacggtaacggcgggcgtgaggataccgtcggcaagcagcgcggcaccgcccagcatggcagggatgatgagccacttgccgcagcgcttgaccaggctgtacagggcgaagataccgccctcgccgtggttgtcggcgcgcagcgagatgagcacgtacttgatggtggtcagcagcgtaaccgtccacacgacaagggagagcgcgccgagcacgaactcctccgtgacgctcccgatgccgccgttgccggcaacgagcgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccatggttgtacggcactgtttgcccagctaaataaacatttatgcggcctttaggccaccgcggcgatatgcaatgtgacaaaggggctgtccctttgtcacattcatcgcatccgttacttgccgagccagtttttgaaccaccactccatggagcggctcatctcggccataaagggactcgtgtgcttgcgggtgtagatatccaccacgcgctcgcccacctcgcgggcatgcggacggaacatcgcgtccatctcggccacctgcgcatccatggtcgcggcatcggcgcggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgcacggcgatcacagcatcctgcgccgcgatggcaaagtcgcccagacccggcgcgcggcggggctgcttgcccgtgcgctccacaaactcgggctcaaagcagcccacatgctcaaacagatcgatccacttggcgtagtcgaccacaaatataagtgcccacggggccttggcaatcatgggctggtggtcgcacaggtcggccaagcggtcgagcgtagcctgctcgcggatactcacgatggagtacatcatcatggcgcctgccgacggcgcgcgactcgccgcgtgcaggattgccgcgcgctgctcgtcggtcaccgccacggggcgatcgtcatcatcgcgcgcaaaggcacgcgtggaagaacggtgctccaagatgtccagcaccgcattgcccgtagcttcgaccggatagccgccggcgtccacgcccacggcaccgccgcagcactcaacgtccgtcttgcaaacctgctcgttcattgcctcatcctcgccatttctttaagaagcctttatctttccgtgtaattcccgtccattatcgcgcaggtcgacactccattgcgcaacaccgccacacccgcgcgttattatggctggttgttgtgcgcagccctcaaatgctgcgcatatcttggtaacaatcgggtaaatccccgctttcgtaggttttaagtttgtgaggagtctcagcatgttcgcagccgctatctcgctgatcggtcttgcggcgaccgtctaccttgttttgcgcgaggccaaggctattcgcgctcagtcgggcgccgtcgccaaaagcgctcttggatggagcgtctccttcggcctgttccagctcttcttgaccgtctggggcgccattggcctcgtcgcccaaaacgagccgctcgcctttgtgatgctcatcctgaccaatgccattctcaccggttgcgcctgggcgagcatcgcccgcgaccgcatcgccccgcgcgtctttgcgttcgcctcgaccgacgcccccgcccccaccggcaagctcgccctcctacgcggcacctttgtgggcaaaccgctcgtcgccgccgttttgtgcctgctgctcgccggcgtctttgcgctgctgggcatggaggtctcgtccaaccacgactttacctgggtctaccccctgtgcatcctgctcgagtgggccatcatcgccacactcatgatagcggccgcggtcctcctcatacgcaagccatacgtcctcgggcgcacaacggtacggataggtcgcaccggcagcgaccatgcaacccaccttgtttgcgggatcgatcttgtgcagaatctcgacagcgcgagcgctcgccataaacatatggtgcgagaacgccgcggtcacggctgcacggtcacgctcatcctcgagcgtgacacccgcgttgagataggacagcgccacgctgttgatctcgttgaacgtaagccaataacgcacgaggccctggtacgcgcgtccgacggtctcgacgtagtgcgcataccgctcgatcatctctcggctttgccagccaccatagcgctcgaccagagccaacggatagtcgtagtgcgacagcgtcacaagcggctcgattccatgctcgcgcagcgcctcgaatacctgacggtaaaactccaagcctcgccgttgggctcggtctccatccctgtgggaaaaatacggctccagcaaattgaaagacgcaggcacttaaagcccatctcggcaaagagctcgacatcctcgtgccaatgatggaagaagtcgttgccccagcggcatggatacagcctgtccggatcgtccacgggcttttgcctgccaaacattacatcccagcggtcggaaccctgtgggatcaggtcggagtgcgacatgccgcggccgccctcgttccagcccccttcggcctggttggcggcgagggcaccaccccacaaaaagccctcgggcataccggcggcagacgttctgtcaaagtaactcatgctactcagcatcctcggcagaagctgccgcggcgttctcctgctcctgagccaggagctggttatcgtacaccttaaagaacgggtaccagaccacagccatgaccacgatcaaaacgatcgtaaacacccagatgcgcgggtcgaggcactggacaaagccctgaacgaagatggggaacgtgccgctcaccaagatgtagaagttagagacaagacccagtgagaccgcaccccaatacagcagggccgagatcatgccgcctagcacaaacggaatcatgaggatcgggttgaagatgatgggcgcgccgaagatcgcgggctcggagatacggaagaagctcggcacgatcgatgccctgccaaatgccttgagctgctgcgactttgccctaaacgcgcagagcgccacaaaagagaacgtattacccgtgccgccgatgaggttgatggccaacgacatgagcgccgggtggaactcaagcggctgcccggcagcatagagcgaggcgttggcggcaaaggcggcaagcgtgaccggggcggtgatgggcattacgatcatgttgccgtggacgccaaagcaccaaaacagcagcgtcatgaagcagataagcagtgcgccgggcacagagtcaactgcgacggaaagcggggcagcgagcagcttctcgataaccgaggggattgacagcgcgggatcgatcatctggatcagcaggttgccgccaaagaagatgaggatgttggcgagcataggtacgatggcgccaaaggtttcggacaaaaacggcggcacgccatcgggcatcttgatggtgatgcccttggtctggcagaagcgcgtgacctcgacggagaccaaggcaacgatgatggcggtaaacaggccctgcgcacccagataattgcaggggaccgcctggagcacggactcgtcagcaagctggtagtaggacgacggcgccgcggcgatcaggaacatcaccagcgaggtcatgccggcgttaagcttgggcatcttgtaggtgcccgccaggttataggcgattgcgaacgtcacgatcaccgacagtatgcccatcgtcatgttgaagggaatgagcagcgtgagcttattggccgtggcaaaatcgagccaagggccaaagacggaccagaacccgccctgcgccaccaggtcggccgtgaccggcgggttggcgaggatcataaagacggcagataccaagatgaagctgatcgcgctcataaagcccttttgcatggaggcaaagtggcgctcggtgccgcagaaattggcgataggggtcagtttttcctgaagcagggtcatgaacttctccatggttgcctcctaacccaacagcgactgggcgagtgccagcacgttggcggcgttgcccatgccgtagtcctgtgcggggatgaccgcggtcggcttaccgctcccctgcttgacggtgttgagctggtaggacacctgcggccccaagagcagcacgtcataattggcgcacgtctcctgatactcgccgatacccaccgcatcgatatcgagctcgatgccgttttgctccgcatatttctcgagtttcttcatcagaatgcttgtagacagaccagctgcgcaaacaaggggctgccctgcggctccttgcccgtgaaccggtactcgacgatggcgtagatgaacggcgcgcgctgcttctcgggcatggcctgcgcggccgcccagaagtcgtcgtgtataaccatgcccatagtgtcgccgtcgccttccctaaaacgggatatcctcgtcgtacagatcgggcatggcctgctgctgcggcgcgggctgctgtggcgcgtacgcctgctgagtggccggctgcggcgcgtaggcgggctgctgcggcgcaggtgccggggcggggcgtccctggccgtacgtgcgggcctgcggcgcttgcggggccgcctggggcgcgtactgctgcggcgcgtagccctgctgctgttgctggctgctcatgaactccagctcgtccaccacgacctccagcgcgctgcgcttctggccggtctgctggtcgttccagctgcggtagcgcagcttgccctcgatggccaccttgctgcctttggcgaggtactgcgccagcttctcgccacgggtgccgaacagcgtgcagtccacgaagttcgggtagtcctcccactgcccggtctgctggttcttgcggcggtcgttgacggccacgcccatggacagcacggacatgccgccagacgtggagcgcagcacggggtcgcgggtcaggttgccggatatgcatacgcggttgatgctcatagataccctccttgggttacgtccccgctgttccagatgcgggtgatctgcgcgtctaccatgcggatacgcagcttgattacgttgatggcctcctgcgaggccttatagatggcctcggagcagtcgcggcggcgcttggcctccgctatctgctcctggccccggcacacgtcgccgatgatggtgacgggcgtgcccttctggcgctcgttcaggatggcgatgcgcagggccttgcggtactcggcctcgttctcggcgtannnnnnnnnnnnnnnnnnnnnnnnnnnnnnnnnnnnnnnnnnnnnnnnnnttgcaggtcttcagctcggcctccagcctgtcggtcagctcgtccagctcctcggtgagcgcctgcatctactcgacctgccagtcggggcgcgggcagcacgggctgttggccacgaactccatgtactgcggcatgctggcgaactggtagcgcgccccgcagctgcggcagtgggccgtgaaggggccgtctgcgggcggctgcttctcctcgggcgcgggctgctcctccatggcgtcggggtcgctctgcccgtcgatggcgaacgccccgcacagcgcgtacttgcgggcgtagctcgacgccatgccggtcacctgggcgtcgtcggagcccttcttgtgctcgtcctcgcgggcgtaggcgctcacctgcagcaggccctcgccgccctcggcggggaacacgcacgccgtggacttcacgtagtagcggtcgcctatctgcaccagctcgtcggtcatgaagaacgccaggccctccttggcgcacggctccttcagcgcggccactatgtcctcgtagctgcggtagctgaacttgccgaaagcgttgtacttggccttgggcaccaccacggcgcgctgcacgcgggcaacggccgccatgaggtcgatgggctgctgttcctgggtcatgctagtagcctccgttcattcgctcgtaaacctggccaaccgtgccgtgcatgatggtgcccacgacgccctgcgccttgagggccgccgcgacgccctgcatctgctcgcgcgtggcgcacggcaccacgaccgtccacgggtcgcccnnnnnnnnnnnnnnnnnnnnnnnnnnnntcgcccgccttggccacgggtgccggtgcgggcggcgctggcggcaccggggcgggcatgggcgcgggctgcggctcgggcatctgctcaagcggctgcgggaactctgcgggctggcattccgcgggctcgggcaccgcttcggattcgggctcttccacgggttccggctccattgccgccttcagctcggcgattcgctggcgctcctcggcggccttgtgcgccgccgttatggccgcgcccaggtccagggtggcgaacagctcgcgctcggcctcgtcgtagaacggctcgccctggaactgcgccttgagggtttcccagtcctgggccaggcgctctaccttggcctccagggccttgaatgccttcacctcgccgaaggtcttgttggtccactgcttctcgtggaaacgctcatagggcacgacgggggccagcagcccggcgaactcctcgtagtgctcctgcagcttcgcgtatgcgcgcgcctggcgctcggcctcggcatcgtccagctgcgccttgatgccgtcggccgcctgcttggcgatgcccgccacggccttgcacctgtcctcgaacgcagccaggggcttcgtgtagcgcgcaaagtctcgcgccagccctcctcgcgctgcatgcccgaaagcgagcgttcgggacacgagataaagtgcacggtcttgtgtccctgtccgagcaagtactcaacaacctggcgcgagcaatcaaactgatcgttatcgaccgtcgagcacagcgggtgctccaacatggtaacgagcaccgtctgcataccgggcagcggctcaaaggtgccaaagtccgccggtatgcgattcatgatcacaaccatgccgtccaccggcagcgcgctcatgcgcgacgatgcgctctcgagggtataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgagaccgtctgctccgagacgcccgcgaggcgcgccacgtctttgacggataccgattttttaacagcgtccataggagatctttctatgtcaacgatgccattgatgacatcctgcgcagtcatgttaaacgccttcaagtatatccaacgcctccccctcaatacgcttaccacccaaaacctaccgttcaccgacaatcttgcttccccaaacggcttttgtcgcccaaatgttaacgttgccattgtgcaaacacagagccaccgggcggctctaacgtttatgcgcaaggaatcgacggtccacaggcacagggaccaccggttcgtgtcttttttcgtgtcgcaaaatggcaacgtcaacattttggcaagctaacgtcaaaagctaccatcgttgctaacccaccgactctaaggagctttgcatggagcaactcatcgccaccatcgaaaaaggccagccctttttcaacgcgatcgcccgcaacaagtaccttaaggcgatccgcgacggttttatctccgtcatccccatcatcatcttctcgtccatcttctgtctggtagcctcggtccccaacatctggggtttctactggcccgatgacatcaacaacgccctgtggaagtgctacaactactccatgggcatcctggnnnnnnnnnnnnnnnnnnnnnnnnnnnnnnnnnnnnnnnnnnnnnnnnnnnnnnnnnnnnnnnnnnnnnnnnnnnnngaacaaccagatcaactttatctcgtgcatgtgcgcggccatcatcggcttcctgctcctttcgagcgacaccatcgccacggacgctgccagcggcttcaacaccacctaccttggctccaagggcctgctgaccgccttcatcgctgcgtttgtgaccggcatcatctataagttcttcattaagcgcaacatcaccgtcaagatgcccgatcaggttccgcccaacatttcgcagacctttaaggacatcatccccttctccgtctgcatcacggtcttttgggtctttgacatcgtcttccgcgctgcctttggcttctgctttgcccagggcgtcatccaggtgttccagcccctgttcaccgccgccgacggctacatcggcctcgctgtgatctacggcgccatgagtctcttctggttcgtcggcgtccacggcccctcgatcgtccagccgggcatcgaccccatccgtcttgccaaccaggccgagaacctgcaggttctgctggccggtggccaccccgcccactccctcacctttaacatgtcgctcgtgggtgagttcggcggcaccggcgccacgttcatcgtgccgcttctgctgattctctttatgaagtccaagcagctcaaagccgtcggtaaggcctcgattgttcctgttgccttcgctgtcaacgagccgctgctctttggcgcgcccatgatcctcaacccctacatgctcatcccctttgttgccgccggctgcgtcaacgtgagtgttgccaagttctttatcgataacgtgggcatgaacggcttctccttcgtggtgccttgggccacccccgcccccatcggtatcttcatcaccacgaacttccagcttattgcccttgtatttgtcgcgatcatcatcttgctggacgccgtcatctacctgccgttcttgaaggcatacgataagctgctctgcgaccaggaggccgagcgcgccgccgagcgcggtaaccgtcgtggcggcaacaacgaccgccgcggtggccgtcgtaacgatcgcaacgcctccgacaacaactccgagcgtaacgcctccgagagccgtccgcacagccatcgcaccaacgccagcaacaacgtcgctgccggcatggacttccccaaccccgataagcagggcaagggcaagaagcgcaagggcggtcacaacaacgaagaggaccactatagttttctaggcaatttccaatctaacgggtgttgcactttcatttagacaacgggagtccatcgcctcgatagcgcgcagcgagagggtcagcgagccgaccgtgcgcaagtatctgagggtcgacgacctatcggccaggccgcccgtgaggcgacgtcgtggttcggtgatcgacgagtggctgcccgtgatcgagggcatgctcgccgaggaccgggagacctggcgcaagcagcggcataccgcgacccgcatccatgagcggttgcgcgacgagtacggggccggggtgtcgttgtcgacggtgacccggaccgtggcccggttgaagcgtgagttcatggcggagcgcgagatgggtttcctggacctgtcgtggcatccgggcgaatgccaggcggacttcggccaggtcgacgtgcgctaccggggcgtcgtgacgcgaatgcggcatttcgtgttggatttcccgtactcgaacatcgggccgagccagctgatgcccggggagaacgcggagtgcacgtgccaggccctcaggaacctattcgaatggctgggcggggtgcccgaacgcatcgtgtatgacaacgccgccggcgtcggacgcaaatggttcgacaggatccgcctgacccgcctgttccaggcgttccaggcgcactacgggttcgagtacacgttctgcaacccgtactcgggacacgagaagggcgcggtcgaggccagggtcggggccgtgcgccgcaggctgttcgtgccggtgcccggcgtatggagcctcgacagcttcaacctgcgccttcccggccgctgcctcgaactgggggacaaggaccactacaggaagggcgagagccagaccggcctgttcgacgaggaccgaaaggcgctgctgcccctgcccgccaagccgttcgacgtggtcacgtggacgaggatgaaggccgacaaatacggaaacgtcaccgtccagggccgccaccggtacgcggccggacccgaacacgccggccatgagatgatcgtcggcctgagggccctggaggtggagatcctcgatgccgaaggcaaacgcgtgatcacgcatccgaggtcctacggggacaagccgaccgacagcggcgacccgtcgagccagctcgggctgttgtgcgaccggccggcggcctggcgcaacagccgggtgcgcgacgcgatgcccgacccgcttcgcgaatggatcgacgcgcaggacgaggccacgcggcgcgacagcctgcgtgccctgctgcacgccgacggcgagagcggctggcgggcggccgtggcgggcatgctcgagatcctcgaatccaccgggggcgcggaccgggccggggtatgtctggccgcggcacgccacgcctcgggcctgggacccgtggcctacgacgaccccgtggacctgagcgaatacgacatcgcctacaccaaggaggacgagtgaaccagaagaacggacggaccgaccccggcccgctgcgcgagcgggcgaggagcctgttcatctcgcaggccaccatcgacgaaacgctcgaatgggccacgccccgccagctcgccgcgatagaccgcatgctcgccacggaactggccaacagggaggcctccaaacgggcaaggctcatgcgccaggcccggttcccggtgcccaaaagcctcgacggctacgacttcgcgaacgtgcgcctgcccgacggatacaccaaggagcagccggccggcctcgatttcgcggccaaggcgcaggacctcgtgttctacggcaagacgggacgcggaaagacccacctggccaccgccctgggcatgctcgccgtcgaacggggcaggagcgtgaggttccggcagaccgcggagctcgtgctccagctcggcaaggccaaacgcgacggcgccctcgacagtctgctcaaagacctcgcccgcgccgacctgatcatcctcgacgagttcggctacgtgcccttcgacatcgacggggcccgtctcctctaccagatcatcgccggcagctatgaacgtcgcagcatcatcttcaccacgaacatcgagtccggcaaatgggggacgatcttcgccgacgacaaactcgccgccgcgatcatcgaccgcatcgtccaccacggacgcctcatcgaattcaccggccccagccgacgcgtcagccaggccctcatgttcggcaagacggacaaccagtaaaacaaaccaccggccggcactcctcatgccgaaaaccgaaaaaaattagtgacgaaacacgaaacaccgacttgactaaaaacaccacgatgcgttacgtgcaccggtggcgcgaggcgaaccgcggcgtgccggatcccatgtaggcgcccatgtgaccgccaagcaggccggtagccacgacatcgtcgcccagctgacccagcacgcgggccacgttgaggcccttaccaccggcggtcttttcgggcgtcacgcggttgacgtcgtcgataacgagctcatcgagttgatagcgcgtatcgacagacgggttcatcgtaacggtgaggatcattttaagctccttatctcgcaggcttcttgtgcctcgcgatacgagtcgacaaaacggaattacagaatctcaatcgtgaacgagcgcacgacggtctccttgggcttggcgataaggcagccgcgcttgtgctcaagcacatcgtcctcatcagagcaggtcgaaaggccgccccaaggctcaactgccacaaagtcgccctcgggcttgctccacacaatcaggtacggcatatcggggaacgtcaggcgcacgcccttgtccttggttttcttggtcaacgtaaccacgcggctctcgagcacgtcaaagatggtctccgcgaagtcgaagagttcgtgggtcagcggcaggttctggtcgatcatggggttcttgctgcgatgctcaacatcaatcaagcccgtcgagggaacggcagtacagagctcagcggcctcgcgctgctcaaaacggagctcgtagtcgtcataggactcgccctcgtcgagcgggcacttaaagccggggtgaccgcccacaaaaaacggcatgtcctcggtgccctcattggtcacctcgtacgaaacggccaccttttccgaatcgatcgtgtaacgagcaacgatcttaaacggatacgggtactgctcgagcaactcggcatggtcggcagagcttaagctcagcgcaaccatgttgtcgctctgttcctcgagcttccactcctgcttgcgcgcaaagccgtggcgggcgagctttacctcgcggccgcccatggtcattgcgacgatccgccagccgtgctcagtgccacgcgaatagtaccgttatcaagaacaaactccataggagccttccctttcttacgacagcccaccaagtcaatagggctgatagaaaaccggcccgcgccccctcacagaaacgcgagccgtcaacggactagttaattacgccggatacccgctaatcatggtattcgccgcggtcccacttctcgaggaactcgtcaaagaagtgcgggtcagcctgagcctcggcgtcggccttattgcaggcgtcgatcttggcgatcagggcgtcgtgctcgggagtcttctcgtagggctcctccaggaaggcaagcatgatatcggccatcaggaactcgccggtgatcttgccaccaaagcccacgatgttggcgttgagctcgcggcgggcatacagggccgaggtcatgtcgcggaccagggcacaacgggcgccctcgcccacggccttgccgtagatgggatagtgtgtacggctgtggctgtaggtgccgcagtcgagcaccttgtagccagcctgctccaggcggtcggccagatagatcttctcgtccgtaacgatatggtcgcaaccgattgcgatggtcttcttcatcagaacgtcctttcgtctgaattcacaagttgaggtagaagttcgagttctcggtggctctcgttaggccatcttgttgagcatgtcgacacggatctggtgacgaccgccggcgtactgggcgcgcaggaactcgcgggcgatcttcttggcgacctcggtgccaacgacgcccgggcccatggtgaccatgcgcgaaccgttgtgctcgcgggtcatgtaggcggagcgctcgtcggaaatgttggcgacgaccatgcccttcatcttgacggcggccatataggagccaacgccgtacttatcgaaggcaaagccctgggaatccttgtgctccagcaggtccttggcgacggcagtcgcggaatcgacaaagtccgcggcaggggtctcggaatagtcgacgacctcgtggccatcggcgatgagcatctccttgatggactccttcatcgacataccgtcggcatcggaagcgattacaaccctcatgacatcctccttgagagatacgcaggtgcgtagtttctgtttggaagtgttgaatcgcgttcaggtccgggcatctgaatgtgcggttcttcactgttcatgtttatttgaacacattcgaacagtgactgcaacaactatttgtttgtctttgttcttttttgaacaattaccgttcacgggcgtttgctgaccgtttgggcccgacagaggcatagacggtcacgcactcgacaaataagggcgaccgagaacgcatctcggtcgctatcctccacgccggcaaccagaccgagctgctcgagagcggcccgacgattgcccccgaggagctcgatgccttcaccgccaagttcactgagcttgcgagcaaggccgacgtcgtcactatctcgggctcgctgccccgcggcgtcgaggcggactactatgccaagatcacgggcattgccgagaacgccggcgccaaggtgttgctcgatacctcgggtgcttcgctcgaggccgcccttaagtccgaaattaagcccgagctggtcaagcctaacctgaccgagatcaacggtcttttgggcacgagctttaccaccgacgatgtggacgagctccgcgcggcgcttgcctccgacacccgtttctccgatatcccctgggtcgtcgtgtccatgggcgccgccggctccgtgggcttccacaacggccgtgcgttccgcgccaagacgcccgatatccctgccgttaacgctacgggctccggcgactccaccattgccggctttgcgcatgccatcgctgccggcgcggacgacgagacagtgctgcgtaccgccaatacctgcggcaagctcaacgccatggacccgatgacgggtcatttggtcatggaccgttgggacgaggtctacaatggcgttgtcgtaaccgagctgtaagagtttggattgcgcctcgatattgctcgcttcctgttggtccgtgtggacgacaagtgcggtagcattatgccggggcgcgacgccgactttgtcgtgttcaatcccgaccttaccctggtcgagacgtatgtgggcggcaacagcgtcggtaacgcgtttaccgagtagctgccaaagagacgatccgagaggggatttagatgatttacggtgcactgggcgatatcgaggaataccgcggcatgctcaagggcctcgacgtgctgattgattggctcgaggagaacgacccggcggagctcgaggtcggcagccatccgattctgggcgacaaggtctttgcgaacgtcatggctcccacgacgcgtcccgaggctgaggctcactatgagacgcatcagcgctatcacgacctgcagatcgacgtcgagggtcgcgaggcctttaaggtcgccacgggnnnnnnnnnnttccgacgcctcgatcgccggcgatctggccgacgacaagtttgccctgttcgttgccggcgagcctcacatgcccacgctcgagttcccgggcgatggcgcgcagccggtcaagaagatctgcttcaagctacttgccgacgcctactgggaggagtagcgagctgcacggctgagccgtgtgttggcgtgattcccttgagggggtcgcgcttgagccccgttgatcgtggcttcccgtttgggagaccgcggttggcggggcttttgttgttgagtagggggttgccggcgacgttgcgcttggattggcgggcgtgcgcaaaatcggcaacaaaaaagccgcccgaaggcggctatcttgtgcaatggagccagcgaccgggctcgaaccggtgacccccgctttacgagagcggtgctctaccaactgagctacgctggcggccatgtggtgacgcaactgaggcgtcaacggctgtctatgatacgggacatcgcaaatccgcgcaagtgttctgacggcttttctcactttaaatgcactaatattcaagacgtgatgtcttgcccttacgggtctcaaacagaatggggcagcgatggctcaacccaagattcttctcacgcgtatcgatgaccgctttatctatgggcaggatgttgagctgtggaatgaggccgtgggcaccaacctcgtcctcatcgtcaacgacgagattgcggcggattcgcgcaagtgggcacccatgagggtggcggcgcccgatggcgtgtggacgcgtttcttctcggtgcaaaggacgattgacgnnnnnnnnnnnnnnnnnnnnnnnnnnnnnnnnnnnnnnnnnnnnnnnnnnnnnnnnnnnnnnnnnnnnnnnnnnttaagggcggcgtgccgatcaccaagatcagcatcggccatatgcaggcaggggagggcaagcgccccataacgcccgcggttgccgtgagcgacgcagacgtcgctgccctcaaagaactgcaggcgctcggcgtagagctagaaatccgctatctccccagctccaatcccgaccccatcggcaatctgttcaagtgatcccttggggacggaggaaaacggatcattttgcccttgcgagggatgcgagcgatgccgtctgtcaaaaactatgtccatttatcgacaacaaccacggtattgccgtcatccaccaggtcgcgcattacgcccaccaagccgtcgacattgtcaggatgcaagccaattgagggctcgtccagcacatagagcacgcctgtcgatcggttgcgcaccacgcgggcgagttgcacgcgctggcgctcacccgtggagagcgtggcaccggcgcgatcgagcgaaaggtaatcgagacccaggtcgaccagacgacgagccgtgctcaaaaacgaatcgcagatatccgtcgccatgggctgcatctcggccggcaaggatgcgggcaccccgcgcacccactcgatcgcatcaccaagcgtcatggccgcggcctgagccagattgataccgcgcacctggggctggcgcgcagcctcggagagacgcgtgccggcgcagtcacggcatggtccctcgcgcaaaaagcgagccacacgcttaagccccttatcgtccttaaccttggcgagcgcattctcaacggtatagacggcgttgtaataggtaaagtcgagcggcgtggcgccctcgccgtttttgggaacgtagagaatgtgcttcttaaccgccgggccgtgaaacacgatgtcgcgctcttgaggcgtgagctggttaaacggcacgtcggtgcgcacgcccatctcgccggccacctgcttcatcaggtcccacatgagcgtgccccagggaagcaccgcaccctcgttgatggtctttgactcgtcgggcaccaggctcgcctcgtctacctcgcgcatgacaccggtgccgccgcaggtagggcacgcaccgccgctattgaaagccaaatcctcggcactcggcgcgtagaactcgcggccgcatgtcggacacgtgagcgacaggcccgcagccacgttaaggctcggctccacgcgcgctccgcagtgcggacacacgtgatgggcgcaacggctaaagagcaggcgcaggctgttgttgagctcggtcatggtgccaaaggtggagcgtacgcccggcacgctcggacgctgatgcaacgcgagcgccgctggcacgtgcagcacctcgtccacctgggcgtgctcggcctgcgtcagacgacggcgggtataggtgctgagcgcctccagatagcggcgcgagccctcggcataaagaaccccgagtgccagcgaactcttgcccgaacccgacacgccggcaatgcccacgagctttcccagcggaatatcgatatcgatgtctttgaggttatggacgcgcgcgccacgcacctcgatagcctgcgggttcatcttctgttccgtcacctttatcaccctactcatgccatataactcgatcgcgaatgtacgcgcccagcatgggcacggtaaaccggacgaggccgtatccggcagcctcgatgacgcgctcgcgaatcaggcttgcgcgatatttactcgcccagctctgagtgcgatcacagcgctcaatgatgtccgccatgcgcgtcggcttgcctccgtcaactgccatggcctcgataaataggcgctgtggactgcgcagcccgtaatacaggggcgcgtcaaccgcttcgtagaactcggagacggcatccgcatggccatcctcggcatcgcgctcttcaatgacctgcgagccacgccgggcagcagcccgccacatgtaatatcccaccagctggaccatatagggatgccccatgctcctgcgcgccgctaggtccgccgtctcctcatcaacgcaaagaccagcgtctttgaccgtctggatgtacgaatcgcgcactttgggcaaagaaatcgcccccagcgtacgctgctgggcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcttcaagcagatcgtcaaccatactgggcaagccggcaaaaaccagcccaagaccgcgctggtcgctattgggcaagcccgtggcatcctgatctccgagcacttgctgatagagaacggcaagagccgccagttcctcgatagacgcagattgcgcctcgtcaatcgcaaacagtatgcccttgcctggaccgagcttcttgaggcgctcgttgaccagccctcgcaatgtttcgccctttgctcgcgccgcctcgaccgacatccggccaaacgacggaccgagctccattgacgtcacaacgggtttattcgagcgaagcgcgtcggccaagcggtcgcataagccaagcgaagcgaacccatgttcatcgccagccgcaaccaggtcgatatggacgagatgggcgccggctacgtcaacggttgggaccagacgcgctttgccgccgacatcaagaaggttgccgacgaggttggctacaccggtccgtactacctgtgccgcgatcacggcggtccgtggcagcgcgacgaggagcgtaacgcccacctgcccgaggacgaggccatggagctcgcccgcaagtcctttgtcgccgacatggaggcgggctttgacctgctgatggtcgaccccaccaaggacccctatcagatcggcaaggttattccgctcgacgtggtgcttcgccgcacgattgatcttatcgactaccttgagcagtaccgtcgcgagcataacctgcccgaggttgcctatgaggtcggtaccgaggagaccaatggcggcttgacctctaccgataagtacgaggagttcatttctcagctgcagcccgagctcgagaagcgcggctgccccatgcccacctttatcgtcggccagaccggtacgctcacccgttggaccgagcaggtcggccattacaacttcaagaatgcccgcgagctcgccgacatggctaagcgctacggcgtgggcctgaaggagcnnnnnnnnnnnnnnnnnnnnnnnnnnnnnnnnnnnnnnnngctcgagcacatcccggctcacgtgacggcctccaatgtcgcccctcagtacggcaccgaggagacccgcgcctacctcaagctctgcgctaccgagcagattctggtcgacaacggcctgtgcgacgatccctccgacttgtatcacacgctgctggtcaaggctatcaagaccgagcgctggcgcaagtggatgaccggcgacgacgttaacctgcaggttgatgacatcctggctgacgacgagctcagcctgaagattctggatgtctccggccactacgccttcaacgatcccgaggtcaaggagcaggtcgagaagctttaccgcaacctcgccgctcaggacatcgacggcaagcgctttgtgatcgagcacatcaagcgcccgatcaagcagtacgtcgtcggtcttaacctcaagggcgtcacgagccgcatcgaggccgctcttgccgagtaagtagcttttcctacgcgacgccgggcctggggcatgtcccagctgcaggcccggcacatgggacaaaggggcagtccctttgtcccattcttttgagttttagcttcctttgaaggggttcaccatgaagttctttatcgataccgccaacctggacgagatcgccgaggccaagagctggggttgcctggccggtgttaccaccaacccgtccctgtacgccaagaccggcggcaagcttgccgactttgagcctcatatgctcaagatcgccgagctctgcgagggtctgcccgtttccgccgagtctaccgctaccacggccgagggcatgatcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgtcaacatgacgctcgtcttttcgccgacgcaggcccttatggccgccaacgccggcgctcgctacatcagcccgttcgtcggtcgtttcgacgacatcgccgaggacggtatctcgcagctcgacaacgtcgtgacctgcattaagaactacgactggacgggcaagaacgtcgacgacaccgtcgagatcatcaccgcttcggttcgtacgcccaaccacgtgacccaggcagcgctgcttggcgccgacatcgcgaccgtgcccatggcagcccttaagaagtgcctgcaccatcccctgaccgatcagggcctcgcgagcttcgaggccgactggcagaaggtcgtcagcgcccagtaacgatggtttcgcctgcccggcatttgtccatgctgggcaggcgcgctcaagagaggaaatccccatgaccaatcaggagctggcgaaggttgccaacgaggtcaggaagggtgtcgtgacggcggtccatgcggccaagtcgggacatccgggcggatcgcttggcgctgccgacatcatgacctacctctactttgcggagatggatgtcgacccggcggatccacaccgcgccgaccgcgatcgcttcgtgctttctaagggccactgcgcccccgccctctacgccgtgcttgccgagcgcgggttcttcgcgcggctgaagctcatcggtaaagcgctcgccggcggcgttgagcaaaatcgcgccctcgccgcgacagctctcgctgatcaggaaggtgcggcccggctgcggcgagaacagccccgtggggtgaatctgcacgtagtccaggtgctccatcttaatgccatgttcctgagcgatgtagcaggcatcacccgtgagctgggggtagttagtcgaatggtcgtatacgccgccgatgccgcccgtcgcccacagcgtgtggcgggcatggatcttaaacggctcgccggcatgcacgccctcggcggcatttgtcagctcgtcggcggggcgagctgaatcgtcctcgtccacggcgacagcgacgacgccggtgcacaccgtggcgccatcgcgctcggtggccaggatgtcggtcatggcaacgtgttcgagaatctgcacgttgtccagcttgcggacagcttggagcagcttggtcgtaatctccttacccgtaatatcggcatggaaggcgatgcgcgggcggctgtgcgcgccctcgcgggtaaagtcgaggctgccgtcggccttgcgctcaaagtccacgcccatggccagcaggtcgttgatgaccgagcggctcgagcggatcatgatgtcgacgctctcgcggcggttctcgtaatggccggcgcgcatggtgtcctcaaagaaggcatcgtagtcagaaccctcgggcagtacgcagatgccgccctgcgcgagcatcgagtcgcactcgtcgaccgcgcccttggagagcatgatcacgcgcgtgctcgtcggcagattgagagccgcatacaggcctgccacgccgcaaccggcaatgacgacgtcgcactccatatcggggtattgtttggtttccacaggaatcctctcccttgtaatgtggcataagggatgcccctcatgtcacattggcttagcgcgccgcgtactcaagcatgcggtcgagcgtgagcttggcctggtcggcggcctcgtccgacacgccgatctgcacctcgccctcgcccgtctccaggcagcgcacgagcttttcgagcgtgatgagatccatgttgacgcaggtgggctgcaccgcagggaagtagaacttcttgccggtgccctggcagcggcgctcgagctcgtagagcacgccgcggaccgtcacgataatgaactcgctcgcgtcggactcctcggcatacttgatgatgccggcggtagagccgatgtagtcggcctcagccaggacgtcggccttgcactcaggatgcgccagcacgagcgcgtcggggtgggcctccgtcgtgtcgacaatctgctcgacggtgatgatgtgatggcgcgggcagtaaccgttgttgaggatgacgtgcttttgcggcacctgctcggctacgaagcggcccaggttctggtcgggaatgaacaagatgtgctgctgcggcagctcggagacgatcttgacggcgtttgagctggtaacgcacacgtcactccagctcttgatctcgaccgtggagttgacgtagcagaccacggccaggtcgtcgccgtactcggcgcgcgccgcatcgaccgtctcgcgcttgaccatgtgcgccatgggacagtccgcgcccggctcgggcagcagcacggtcttggtgggattgagcagcttggcgctctcgcccataaactccacgccgcacagcacgatggtctgctgcggcaggctcttggcaagctttgccaggtagaagctgtcgccgacgtaatcggcaacagcctgaacctcgggcgccacgtaatagtgcgccaggatcaccgcgtcgcgttgggttttaagttgctgaatggcctcgacgagctctgcgggcaccagtgccgcgcgctccgttgccgtcgttgccgatgctatcgcgtgcaagctccgacgcatccatgttcgcgctctgtgccatcaaggcccctctcttttggcgaatcttggggctttagtatgacacctaggtttacagctgacaagacagctgtaaacctaggtgtaaagttgaaataaagattcgaccatgcggcaagtccatattcgaactggcaagctgaggatagccgagctctcgatagcgcaggaggcatctttcgccaccgcaataccgctcggcgcgagttgcgcaccgtgaggcacgaacgggcgctcccccgcgagtggtccgcgcccaatgtggcaaaatcgaactatacgcgggggcgcatggcgaggatggcagcgatggccaccttttgcttctgtccgcccgagagggtggcgatctcgcggtcgcgaaggtcgctgataccgacggtctcgagcgtctcgtttacacgctgctcgatctggtcgtgagggacgccaaagttctccaggccaaaaagcatctcgtcctcgacgaccgaggcgaccatctgcgtgtcgatgtcctgcagcacgctgccgacgatctgcgacacgtcggtgagcgagacctcgcaggtgtcgtggccgtcaaccatgnnnnnnnnnnnnnnnnnnnnnnnnnnnnnnnnnnnnnnnnnnnnnnnnnnnnntggtggggcacagcgcccgacaggcaggcggcaagcgtggacttgccggcgcccgagggcccgatgatgccgataaagtctcccttgttcacgtcgagcgagatgtgcttaagcgcctgctcggtctgcgtaccataggagaacgagacatcgtcgacgttgatgatcgttttcatggatacctttcatggtcattggggacgttcttaaatgacgagtcgtttaagaacgtccccaaatgctagctgtttgggacagtctttggtgatggggccgctaacgcgcggcccgtccatcatatcaggctatttgttgagcaccttgcgcagggggaagaagagagcctggaccacgacggcgttgaagacggcggtgccgagcacgatgggcaccttggcgagcgcggtgggcagnnnnnnnnnnnnnnnnnnnnnnnnnnnnnnnnnnnnnngcccaggacggcgaagagggcacctgagaccagggtggtgagcaggccggcgatgaaggggttgaccttgttgccgccgatgttggacttgacgagcgccgccatcgtcagcgcgccagcaagctcggtcacaaagttgaggccggggattgacgtggtgatctggatgacggctgccgacaggatgccaaagatggctgcctgggcaaagctcgcctgcgtgagtgcgatggccagggcgtaggcggcaatgatgaactgcggcttgatacccgttgcggcaagcgcgttgcccacggtcatgttgaggataaagccggcggcaaggaggacggcgagcaggacgagcgaggtgatatcgaggatgcctttgtcggaagcggcgttggcagaaatagtacgagcctgagtgtcggtggccatgatgttctccttaaggtgggatttgagataagagtgtcctagacccccacgaaaggggttaaatcgaaaaagggattaattttgaataatggagcacggagacggctttacgaggggccccaggttggcgcgaaagaggagcgaagcgtacttgggtacacgagcgacgaatnnnnnnnnnnnnnnnnnnnnnnnnaccaggatggcgttaaagacggcggtcatggcgacgacaggcagcatggcggctgcgagctcgcccaccacgccgagcatagccatcttgatgaccatgaagataacgcccgagacaaaggtggtcacgaaggtggcgacaatggcgacgacaggcttaacttgaccgttcttgccggcggcgttaacgatggcggccatgagcatggcggcgatgccctcggcggcaaaatcgatgaacggcgaagtggtggtgatctggatcacggctgccgagataagaccgatgacgagtgcnnnnnnnnnnatgttggggcgcacgaccaagatggtgaggcagaaggccgagatgatgaactcggggctgatcatgccgcccgagatgcccgagatggccttaccgacggtgaagttgaggataaagccggcggcaagcagaatagcgagcaggacgagagcacggacgtcgagtttgccgcggtcggcggtctggacggtgcggggctgggtggcggtggtgttctgagacatggtgaaaatcctttcggaaggggagtgcaagagaaagtaagcggaggcgcgtgatgcgaatgcgatcgggctcgagatagaaaaaggcccccggtcgaaaccggaggccttccaatcacctagagcgcaaaaacaggcgtgagggactcactgtcgaccgatcgtattcgcatcacgccaccaccagttgttgagagacttcatcgtgttcttcatgttggtggctcctttcgtgatgccgtggcgcggtcgcgcctaattgctgttgcgctgcactataggacagcaacggcgattatcagggctttgaccttgagcttatcaaggctatcggcgacaagctgggcctggatgtcgagtacgtcaacaatgactttgacacgctggttccgggcgtcgcttcgggtgccaagtatgacgtctccatcgcggctatcactgacacgcccgagcgtgagaaggaagtcactttctccgattcctactacatggacgatcaggccatcgtgaccaaggtcgataacgccgacatcacggctgacaactacagcgagaagctcaacaacgccgacgctannnnnnnnnnnnnnnnnnnnnnnnnnnnnnnnnnnnnnnnnnnnnnnnnnnnnnnnnnnnnnnnnnnnnnnnnnnnnnnnnnctccgttgccagccagctgaccgccgagcagttcaacacctgccagaccatcaagcagatcagcaccggcgaggagtacgccatcgccatcaaccagggcaataccaagctcaaggacgacatcaaccaggctatcaaggacctgaccgacgacggtaccgttgacgccctcatggctaagtacaacatcaagtagaatagtcacttgattgcaagcgggccctttccgttttggcggagagggcctttgcgtttcttgaatgggcgtcatcccgccccgttatgtcggcaacttaaacgttaggagccaccttgtctcgattgaaccaaggagccatgggcaagagccatccactgcccttgatgctccaaaagctggcctgtgccctggctgtggcgctcgccctggtatgcgcgggggcctgcgtgccctcgaccgctcaggcacttgagaccgcaaagatcaccgcccgacccaataccggttcgggtagcgacgtggtcggtggcaccgagactcgtatcacctgggaggtccaggccgatgccgatgaggagctgagcggtctttcgctgacgtttgtcgatggcacgacctttggtgcggacgacacgcgtctgacgatgctctcgggcgatgaccttatggaccgtacgcccatgaagcccacgtgcaaggtcgatggtcagacgctcaagatcgattttggtgagacggcgcccgccggcggttatttccgtgtcgaggtctacggcgtgaccttccccgtcgagggcggcgacgaggcctttagcggcacctacactttggccgatggttcgaccaagaagatctccaagattccgtcggtggagatcaagggcgtgacggcattcgataacttcctggccgaccttaaggagcagccgtgggtcgaggcatggaattccaacatgttccttcgcttgttcctgaacccggtcattttggtccagagcctgccgatcgtcttcaaaggcttcctcatgtcgctctcgatcgtgctcgtggcgtttccgctggcaattccctttggtttcgccctgttgctcatgcgcatctccaagtcgcgcatcctgcgttgccttgccggtatctatgtgaatatcattcgcggtacgccggcgttcctgcagatctatatcgcgttcttcggtctgccgttggccggcgtcaaggtggacgactacgtgctcggcgtcatcgtcatggccatgaactcgtctgcgtatctgtgtgagatcttccgcgccggtattcagtcgatccccaagggccagaacgaggctgcgcgttcgctgggcatgaacgcgttccagacgctggtctatgtcatgattccgcagacgttccgtaatgtcctgcctacgctgaccagtgaatttatcctgctttacaaggatacgtcgctgctcgcggctgtgggcgtggtcgagatcgtcatgaacgcccgcaccatcgtggccacgacgggctccattacaccgtacgtggttgccgccctgttctatctggtcatcaccctgccgctcgctcgcttggtgagcggtcttgaggcaaggcttttaggcacggccgagaccaagaagaagcgtcccgccaagagcgccggacaggttgtcgcgacgcccgccgatcacatcgccggtctgtaaggaggtcctatcatgagcgaaaccaataactcgaacgaggttgtcgtcagtatcaagaacctccagaaagcctttggcgataacgtcgttctgcgagatatcgatctggatgtgcataagggcgaggtcgtcgtagttctgggtccctcgggctcgggtaagtcgacgatgcttcggcgtgtggaccttgagtacaacgggcgcgaatcgatagcggttcgcgcccgtttgccttgggcgacgagatggcaagccctgtgcgatggtaagatgctttggtgtgtaaagaggagatttgccatgagcaagacaatagttaagcccacgctatcgctgggcaaccacatctatctgtatcgcctgctgcgcgacgcgattgggtgcggtaagcaaacgtttatgacgcaggtcgaggaggcgctcgccgccggcgacatggccgcttatgacctgggcttcgagtccacgcgcgagttgctcgaggaactcgacgactgcattaagctgactgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagcttcccgagcccgagtccgtggccgaagtcgctccggagcccgagcccgagcccgagacagagatcgaagtcgctattgaggtagcagcagaagccgaaaccgaaatcgccgccacgaccgatcccaaagccatgtcaaagcaggaagccgctgcggagctcaacgagacccccaagtcgacaaccgaagaagccgccaaccaacccgagacgcctgcgttccaaaacagcgatgtctttggcaacgaggccgaggacgatcagtccgacgagcccgccgatcaaggcgctaccgaatcggcaccggagcccgagacgccgctgcccgccatctcgctcacggtcgtctatgaccccgagaacgccaacgccggcatcaccaccatggcctccacaccgatcgaggcaaagccgtctgtcgaggcagaggacgccccgcaagccgacgccaaaaccgagactgaagacacatccgtctccgtggaaccgacagattccgcagttaagccagaaccggcgcccgagtctgcacccgtcatcgagtccgcatccgcacctgtctatgaccaaattcccgcaccggtaccggcttcggtacccgcagcagcaccggcccccgcacccacagcaccgaccatccccgaggacttccccgtcgatttcgcaaccgaggtcttctgccccggcccgttgctacnnnnnnnnnnnnnnnnnnnnnnnnnnnnnnnnnnnnnnnnnnnnnnnnnnnnnnnnnnnnnnnnggcaccatcgaggccgcgcgaaaccgcgcaatcttccccctgcgctacacgcaggccggcgagcgccacgaagtcaccgtgcgcatccgccgcaacaccaccggaggcctcggagccacctggaccgtcgacaaggttgaagaatccaacgaatagcaaaatgcggcgaacgtcacaaaaacgttcgccgcatttttttattttcccaggttgagcataagttcgtgtgacaaaggggctgtccctttgccacatcaaactagtccctggtaagtttcctgtggatacgatgcggctgggctgcgtcctcgcccaggcgctcgatacggttggcctgataggcctcaaagttgccctcaaaccaataccagttgcccgggttctcgtcggtgccttcccacgccaggatgtgcgtggcgacgcggtccaagaacatacggtcgtggctaatgaccaccgagcagcccgggaactcgagcagcgccgcctcgagcgaggacagcgtctcgacgtcgaggtcgttcgtgggctcgtcgaggagcagcaggttgccgccctgcttgagcgtaagcgccaagttcagacggttgcgctcgccaccggagagcacgccagcgcgcttctgctggtcctggcccttaaagccaaagctcgccacgtacgcgcggctcggaacctcggtctcgccgaccatcatgtggtccaggccgtccgagacgacctcccacaggttcttatcggggtcgatgccggaacggttctggtcgacgtaagaaatcttgacggtctcgcccacctcgagctcgcccgaagtcagcggctccaggcccacaatcgtcttgaacagcgtggtcttaccgacaccgttggggccgataacgcccacgatgccgttgcgcggcagggtgaacgaaaggtcatcgatgagcacgcggccatcgaactccttgtgcagatgagtcggcggcaccgctgccggtctgttcgacgtcgtgaccgcacagggcattgttaagtccctgggtatgggccttatgatgggctttggcgtcgccgtcgtccttaaggacatcctgccgcaggtcgccggcatcgtccgcggtcttgccgccgacagctccaccgacaccgacgagcagtcgctcatctcgggctcccttaagctcgacgccggcatcatcggcctgggcgccgccgccatcgccgtcgtcatcgccatcgcactcgaccttggccccgttcctgccgtcatcgtcacgctgttcacctttgtcaccaccatcatgagtgcgcagagctgcggccagacgggtatcgaccccatggagatctttggcctcatcgtcatgctcatcgtggctgcttttgcccagatcgctcaggtcaagctgttctttatcgccggcatcgtggccgtggcgtgcggccttgcgggcgacgtcatgaacgactttaaggccggcgccgtgctgggcaccaacccgcgcgcgcagtggatcggccaggccatcggcggcatcgtgggcgccctggtcgccaccgccgtcatggtcgcactcgtcaccgcctatggcccggacgcctttggccccgacaagagctttgttgccgcgcaggcaagcgtcgtcgccaccatggtctcgggcatcccgagcgtgccgtggttcgtgggcggttttatcgccggcatcgtcatgtactggctcggcattccggccatgatgatcggcttgggtgtgtacctgccgttctacatgtcgctcacggccttcctgggctcctgcgtcaagctcgcctacgacaagtgggccgctcaccgcgacgccacggccggtctttcggacgaggagaaggccgccaaggacgctgccttccaggagcagggcctggtcgtcgccagcggcctgctcggtggcgagtccatcgtcggcgttatcttggcgtttgtctctgttggcctgagcctgctgggctaagccgagcagctgctcgcccgaatccattttgtctacggctagcccggtaggtggcccatgcggtcgcctgccgggctttttcatatcgaaacagtaaaaggccggcgcgcaactttaaacagcgcgccggccttatcaatttaactatcgaggcggcgtcgcaacaaaccgtagtccattgcgaggtcgacgctcgaagcgctacatctgcttgcgacgacggtcgctcagcgtcacgcccgcggcaacgagcgtaataccgccaataacgaagacctcgcccgcaagcgcggagttgtcgcccgtctgggaaagtacgccatccgcagtcttcttcttgacggcaggggcctttgcggcagtctgcgtaacctgaggcttggcctgcggctcggccttgggatgatacttgtcgtactcggcctgtgcggcagccagggcgtccttggcatcgccaagttctgccagtgcagcggcataggcgtcgttggcatcggacagcttggcatcggcatcgctcagggcggccttgagaccagcggcggcatcgacggcagccttgtagcgagcgtaggcggcattcagcttgaccagcttatcgttgcccgtcgtgcccgcggcaagagatgccttgtggtcgacggcctcaaggtcggccttaagtgcctcgtcgtttgcgagctcggccttggccttgacgatctcgaggttcgcatcgacgacggcctcgttggcggcctcgagctgcttctgggcatcggcgacaccggcgacggcagcatcataggcggccttggcgtcgtcgaccgccttctgggcgccggcaaagcgctcgaaagccttgttcgcggtggccagctcgccctcggcagccttggccttggcctgcgcgtcggacacagcctgcgtcttggcgacaactgcctgcttggcgtccgaaagagcggtcgcggcctgtgcgcctgcggccttggccttgtctacaccagcctgggcggcgtcatcggccttcttggctttgtcaagggcgccctgcttgttcgcaaggtccgtcttggcagtgtcacgcttggcggtaaggtccttgaccgaagccgtagcgttgtcatacgcctcactggctttgtcggactttgccttggcggcatcgcgggcgctgagagccttttaagtccctgaaaatctaagccaggctttccctcaacaatcggcagaaatgaacacatgaatagaggattaacgatgccgttgagaatggtcacagcggtactcttttttagtgtcaagtagaccaactccttttgcccttgtcggccaggcccaaagggcggaagcgaatattacataagtgaatcgggagacggcaggaatggcgacaccagcgccgtcgcgccaaacagaacagcgcacccaaaaagcagcgtttcgtagctctcgccaatgcagaaggagagggccacgggaatcaaaaacgtaagtcccagtgaaacggtgctcaccacgccgccggcgcttcccgcaagtccctcgcgcacctcgggcagcatgtagggcagcgactgaacgaccggaccagcgacggagctcgaaacgccgatcgcaaacatcagccccacagaaggatgggagacaaaagcctctcctgcccacataagggcacttcccgccattgcggagatggccataaacacgcgataatcgccaaattgcgcccgcacatagggtccagccacgctgccgacaatcgatccaagcgtcacgaaagaggcgagaagtccagcagccttgggttcagttgaagcctcaagcgctgaaacaagataacccgagtacgccgtagccgatgcaagggcaactccaagcagtatcgccacgagccaaactatcggcatcttgattaccgccgcaaacgcacttgccgacgatgcagcaggctccgcgccctgaacgccaaagccatctgcagcctgcagaacatctgccgacggcgttgcaaagagaggagaggttgcaagcgagcaggcgattccgcccgaccccgcagcgtagaaccatcccatggccctatcggtttctccgccaaaagcggaaccaagcacttttagaacgatggcattcacgacgcatggtgccgcacccagaagcatggtcgccgtgaacagcgtcgcaaacgatgcgcactccgcgcgagcagccgctgcaattgcagaaatcgccgacgcgatgaatacgagcgccttcacgccatatcgatcggcgcaaacgccgacaggcatgccgaatacaacggcaggaacaaacggggcaaacaggacggctgaaaactcggccgaggtcagatgcaggtccgacacaaccagatgtgtcaatcccgacacctgatactgcgcgtagttcgcagcaaacacgatgccgcacaccacaaacagcagggcatatttttcgaccgtccctttgctcacgttcatcaccctatctatgcttcatccttgcgatagacgacgcgtccgttaaagatcgtcgtctcgacttcgagatcgcgaagcgccatcgggttcatttcaaacggattgcccgacaggatgacgatatcggcaagcttgccggcggcaaggctgcccaaacggcgctcaaagccctcgacatatgctgagccgagcgtgtgcgcttgcagcgtctcgccgagcgtcagggcattctcgcggaagtatccctccgccgggtgcccgtcaaactcgctacgcgtcaccgcagcatacacggtatcgataggatcgattgacatcaccgcaggccagtcagtaccaagccctaagtggattccgccatcggcctcttccctatagcgccacatgtggctcatgcgctcttcgccgagcgagccctcgtacacgccctgcccaaggcctccaatgggatgctgcggctgaatcgcggcgttgatgcccaggcgcttcatacgcgcaatgtcctcaaactgcaggttgtcggtgtgctcgttggcaaaacgcgtccccttgtcgccgcacgcctcctcggcgcgctcgacggcatcgatgatcatcgtggccgaggcatcgccaatggcatggatgcgaacgtcaaagccgctcttatcggcctcgagcaccatgcggtcgagcgtctcttggttgcacgccggctcgccgcggaagcccttgcccatgggggcgttgagatacggctcgtgcatgtatgccgtataggcctcggggcagccgtccaggatgtacttaaggcccgccatgcgcacgcgctcgccatgatggcgcgccctcagagcctgcgactccgccatgggagcatagagcgcagagtaatagggggtcgtagaaatagaatcggacgatacttcgacaggtccgccaaaagtacggacagctgcggctccaccggcaagcggagtcgccatctgggcttttgtgcgtcgcggtgccgaaacgggaagttcaaaggcaaagcccatcgcaagcaaaaaccacgtaagcgtataggttgcaaccagagcggcaacaaggccgcccatcacggcgcgttgggaaaatacgctacatgcagccacaaccagcaccggaacctcgcaggcagaaagcgcaagcacaccctgcaggaagcccgagcgccgatcgcgcgcaagtgcccccgcggcaacgccggctatgcctggcagcgccaacgccagtgcggcaataatacccggtagcgacccagaccacacgagcgatcccaaagtcgccgtcacgcgagcgcccgacgccagcagcgcgaccgaaaccacgaccacagcccaaaccacgccacagacgaccgtcgcgccgaccatcagcgcgcgacgaaccgcgcggccagacgcatccatggggcacggcgtgagcggctcgccgcgaagcgaacgaccgacattttgcgcatagtggtcacaaaacgccgagagcgccgcctcgaccgccgccggctcgggacgatctttttgatggctggacagacaggccatcaccacgtcgaacagctgggcatcgacaaacgccagcgcatcgcgtagctcttcggaatccggctcaagccctagctgctgggcctgctcggccgcggcgagcgccacatcgggctcacgacgaagcagctgagtcaaatcacaaccgggcgcatgggcaccaatgggatagtcgggccgcgtgtccatcttgagacggtaggggctcgcgatgtcgcgcgtctttttgcgcgaacccgaggtgcccgaagtgctcggcgcggcttcgtatggcgcgacgccggcaatgagctcgtaaaccgtgcttgccgcggcatagacgccaatcgccggcgacatacgcaaagcgcgcagatcgggaatatcgtcggtgagcatctcgggtggggcataggcaaccgtcgcgcgacgcagcgtggcatagcgctccgtaaacgacgccttgccgccggtaccggccacggccgacgcaggatcgagcgccagcgacgagccaaagtcgatcaggcacaggtcaaaggtgccctcggcaagctgccggtcaagcggtaaacgcgccgtacgcaccataatattagcgggcgagatatcgcgatggacaaagccctcccccaccaggctcatgcggcagagcaagtcgaacaggtcgcgccccaagcgcgccgccacaagcggcgataggcggccggcatcgtccacggcaaagcgcgagcgcaagcgggcgagcgtctcgccctcgacccattccatgacaattgcaggcacaccgtcaacctcgccccagccatagaggcggggaaagcccttaaggcccgaaagggcgcgatggcattcatattcctcgcgaaatgccgctttgaacttggcgaccagcgcctcatgggcggcatcgtcgtcaaactcatcgcgcgtcggcaagatgagctgtttgagtgctacggcctcgccttgggcgttgacggcacgcgtcacgcggccgataccgccacggcgcatggtggcatcgtcggcaaannnnnnnnnnnnnnntatcgtaaaacgacgcagatagacaggcagttcgtcctgaccgagcgcaatggccggctcaaacccgtcgacacgcgccaggcgcaggccgaccatgggatcgcgaccgagcgattgtggtgtggtggatgcaagatcggtcatcatagggcaagcgccgccacgttattgttgaagttaccgagcgcgacgtcatcatcgccgtaatggccgacccattgacataggttggtgtaacagccccacagattggcatactgctgataccactttgaccggggcgagaatgtctgacgaccgaactcggctcgaatgacaaacatctccccgaccaagctgtcgcacggcctgggatctcccgtagagttataggtcgagaccacgtcattggcacgagaaacatagccgtcgagcatgttgtacttggtcacaagccaactgtgaatgctctcttgaacgttttcgctgtccgtcctctatctgcagcattgctctcgtgccaatgatcccttggggacggaggaaaagggatcattttccgaaacctttccgcaacaattcgccctccacggcgccggcacccgtctgctgtgttccctgcgctacacttagtcgcactgtggcgactttgcgccgctcccgacccaagggggacactcatgaagaacactcagctgctgctgatcaacgatatgtgcggctacggcaaggtcgcgctttctgccatgctgccggtgctgtcgcacatgggctaccgtatccacaacctgccgacggcgcttgtgtccgatacgctcaactaccccaagttctacatccacgacactacggagtacgtgcgtcagagcctcgccatctgggaggaactcggctttgagttcgacgccatctcgactggctttatcgtgaccgaggaagagacgcgtatcatttcggatttctgccaccgtcgcgcgcaaaagggcaccaaggtgttcgtcgaccccatcatgggcgacaacggcaagctttatgccggtgtgcccgagtccacgatcggcctcatgaggcacctgctcgagtgtgccgactacgcggttcccaactacaccgaggcctgtctgctcaccgannnnnnnnnntacgcctattgcagagcaaatcacgcccgacgaggcccgcgtccttgtggacgccatgcgcacgctgggcgccaagtcggtggtcattacgagcgctgtggtcgacggcacgaacgccgttatcggttacgaccacgtggcgggggagtacttcacgattcccttcgacctgatcccggtttacttcccgggtacgggcgatacgttctcggcggtgctcgtcggtcgcgtgatggccgggtggagtctgcagcgcgcaacggccgacgccatgcgcgtagtggccgagcttatcgagcgcaacgccgaccaagaggacaagtctgccggcctgcccatcgaggcctgcctggatgtgattgaccatgagtagcgccggcgagggcggcgccaagcccgcgggcgaaggtaagccgctcggcgcgccgcgtggcaagcgcccgcgtattcgcattagctgcgtggaccagctgggtacgtgtcgctgccaccatgggcacaagccgggcgacgtcttcgacttcgaccgcgatcgcggcaagatgtgctccatggcctgccacgtgggctttccctatatcgacatcctgcgctacggcggcaccgtgcctggcaacgagcccggcacggcaaagttctgctgccccgaggtcgataccctcaacgtttggctcgccgagatcgtcgacgagtaatcgagcgtggattttctcccgccaagataatgagcgtggataatctcccgtttagagcgccgtttcgcgctcaaagtgggagattatccacgctcaatttgtatgcgggggaaatccacgctcgttttatgccgatggtgtggctcgtgcgcctgcgacgaccgaacgtctacagttgctcgagcatggccgtgcagccggcaagcacatcacggtacgtggcatcaaagttgccggtgtaccaggggtcggccacatcgccgggtcgatcggtccaatcgagcaggcgcgaaatcttgccgtcgggatcgtcgccgaagatgcgacgcaggccgcgcgcgttctcggcatccatatagacaatgtggtcccagtcgccatactccgcgcgacgcacctggcgcgcgcggtgggcaacgacgggaatcccggcctcgcgcagcttggcgacggtgccatgatgcggagggttgccaatctcctcggtcgaggtcgcggcggaatcaatgacgaactctgcctcgcgcccggcacggcgcaccagctcggcaaacaccgactcagccatcgtcgagcgacagatattgccatagcagataaaaagaatgcgttgcatgtgatggttcctttcggggcggttgcgcggggtttacagactggccttgaggcagtttgctccgataaagcccgctgcgtacaaggggaggtggcgcagctcgcacccgtcctcggtttcgctgcgggcaaaattgttctcggacaatatgtaggcatacggcgaccgggtcacggtgccgagcttggggttcggcatgaggccacggggaccaaggatcttaccgatgcggccaaccttggccatcatgttcggcgtagcgatagcggcgtcgaagttgatctcgcccttctgaatctgggcgacgagctcgtcggaaccgatgatgtcggcgccggcagcctcggcctcgcgggccttctcgccctcggcgaagacggcaacacgaacggtcttgccggtgccgtggggcagggagatagaaccacggatgttctggtcagccttacgagtatcgatgcccagacggaagtgggcctcgacggtctcgtcgaacttggcggtgtcgagctccttgatgagcttggcagcctgaaggggggtgtagagcgtggcgcggtcgatcttctcggcagcggcgttatagctcttaccatgcttagccatgtgcattacctcctgtggttaaacgggcttatgccctcccacatcgtttcgtgtgccctattgcacacatataacgggcgcctcggtcggggcacccgtcattacctaaagaaatcgctactcagcgatggtgacgcccatggaacgggcggtaccggcgatgatcttcttggcggcgtcaatgtcgttggcattgaggtccggcatcttgatctcggcaatcttggtgagctgctcctgggagagctgaccaaccttgtcggcctggggcttagcagaaccagacttgaggttcagctccttcttgatgaggtgagccgccggcggggtcttggtgatgaaggagaaggacttatcctcgtagacagaaatctcaacggggatgatgtcgcccttcttgtcctgcgtctcggcgttaaaggcctggcagaactgcatgatgttcacgccagcagcgcccagggcggggccgacgggaggagcggggttagcggcaccagcaggaatctggagcttaatgacgttggcaaccttcttctcagccatggtcattcctttcgaatcacgagtgtgaagtacttgctatatcgtaagcacgcacgtgttagaagcactcctgagatgagcagtcacagaagaagcacgctcgcgcgaacggacgaaaacttaagcgatgacagcgacctggttaaagtcgagctcgaccggcgtctcgcggccaaagatcatcagcgtgaccttgagcttgccagcctcggtgttaacctcggagaccttgccatcaaagtcggtaagcgggccatcggtgacgcggacggacgtgccgacctggatatcaaccgaggtgcgcttgggcgaatcgcccttaccgggacgacgagtcannnnnnnnnnnnnnnnnnnnnnnnnnnnnnnnnnnnnnnnnnnnnnnnnnnnnnnnnnnnnnnnnnnnnnnnnnnnnnnnntccaggcatcgtcatccatctccatgcggaccaggacatagcccgggaagatcttggaatccttggtctcgcgcttgccaccctctttaatctcggtgacgcgctccataggaatctcgatatcaaagatacggtcctgcatgcccatggtctcgatacgatgctcgagatcggacttaacgcggttctcgtatccggagtaagtgtgaacgacgtaccaacgcttagacatggtttagcccctcaatccagagaacagagcaagagcctcgccaaagccagcatcgagcagagcgatgacgacgccgacgacgatcagagaagcgcaaacgacaaccgagtagttcacgagctccttcttgtcgggccacgtgacacgcttcatctcggacttgaccgaagcgaaatacttcttggtgcgggcgaagaaaccaggcttctcattcttcttggacttcgcagccttctcgttcttcttggcaacggccttcttggcctcaaccttggagttggcggcagcgttgttggcaggcgccttctgctgagccttcttcttgttcttcttgttggccatttgggttacctccgcgcaatgcgcttatacatgagtaaaccgtaagcccccaattgggagcttacggaataatgactggcacgccaggaaggactcgaaccctcaacactcggttttggagaccgatgctctaccaattgaactactggcgtatgtatcgatgttgcacgtgcagatgagcttgctcgcttgctagacggtgcggctcaggcccatccgggcattcctgatacgcgcgacggccgtgtgtccttccttcttaacgacctcctcatgcggtcccagtgggtgacgattgaggagtatgcggatttactctacgtttcggcgcgaactctgtccaatgacatgcgtctggtagagcagaaactcgcccaatttgacttaacgctcgaaaagcgcccacgctacggaatccgcgttgcgggcggggagtcgcaacggcgcctgtgcctggcctcgctggtgaggcccgtgttgcccgacaccgacgatgcaaagctcgccgagcgcctgcgggccatcgccgcatgtgtggacgatgccctgacggcctcgcccgtcacggtgagctcgctggcatcccgcaatctcatcatgcatctttacattgctcttggccgcatcgagcagggctgctatgtcccagctgcagaatcggacgttcaaaaactggagggaacgcgcgaatacgccgcggctttccagattgccgcaaacatcaaggatgccctgggcgtgagcatgccacgagaagaggttgcctttatcgcaatccatttgctcggcaggggcacgggcgtgcccgagaagggctctgccgttatctcggacgagatgtgggagattgcttccgagatggtacgtgcggtcaacgatgagtttaggtttgactttagcggcgatcttgaacttcgcatgaaccttgctcggcatatcggccctctgggctatcgccttgaatatcacatgcatatggataaccccatgctgcccgatatcaagacgaggtttccgttggcctattcgatggcagctggcacctcgcaggtactcgagcgtcattttggcagccagccctctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgtcgcaaacgcatcctgatcgtgtgcgcctcgggagcgggaagcgcccgtatgctcgagcaccagtaccgcaagcagtttggcatgtatatcgattcgattgagacatgcgatgtcgcccgcgtgggaacgttcgatttttcgcatatcgactacgtgttcacaacggtgccgctcaacgtcaagttgcccgtgcccgtccgcgaggccgatttcttcttggagacgagcgatgtcaacgctatccgcaaggtgctgagcgacgacactgcgcaatcggactccgtgagctctttctttagccgtgccctgttcttcaaccgcgttgaggcgtcgtcgaagcaggccgttctccgatatctctccgagcgcgccgtcgagagcggccgtgtcgatgcccagtttgcccaagaggtcgccgagcgcgagagcgcgagcgccacctcgtttggcaatggggtagccatgccccatgggatgcatcccttgagcgccgaggcctttgttaccgtgggcctgctcgaacatcccattctttgggacgaatacggccatgaggtcgatatcgtctttatggtgtcgtttgcccggtcgggcggcgatgaggcgnnnnnnnnnnnnnnnnnnnnnnnnnnnnnnnnnnnnnnnnnnnnnnnnnnnnnnnnnnnttatggaccgccagggggtcgagcgcctacgcgagcgccggtcctggcatgagctgatggcgcttgtgcaagcgcatacggcttaagacttcttttgtcgatgaccctgtcagtctacctgcaataaacctcgaggattgcgggcgggagataggcgtttcgaatattcaagtacaaaccaaacatcacgggagaggagaccgttatggacgatcagggaaccgagatggtttcgtttcagctggtcgctgcagcgggagaggcacgcagccttgccttcgaagcccttgaaaaggcaaaggcgggggattttgacgccgccgccaaactcatgaagcagtcaaaggatgcgggaatcaaggctcaccacatctaacgaaactattaagcagttgcgaagtgagatcatgtcggcagaaaggcgagaaaaatcttgtgaagatgatcttcaccactgccaacgccggctcgaaagccaggaaagtgtcgtcgcgaagttcgaagccaatgcggaaaaatgtcaaaccgatatcgacgaagagacagccaagcgagatgcgctcctcggcgatttaaaaaaggcgcaagcggcctatgacgacgcctgcaaggcatacgaagaggcaaagaccgcggcagacaaggccacctcgcccgagataacgaaacccgccgagacaacgcctccctccggctcggcgcaaccgaccgagacgacacagcccaccggctcggccgcgaccggtaaagacgccgcaccgagctccgccaagcaggcgaacacgggcggcggcaagcaagcaactacgaccgccgacaagctcgcaaacaccggcgacacaacgccgagcgcaatcgcactcgcaggaatcgccgccatgggactcggaataaccgccgcagccacccgccgcctcaagaactcaaaatagctgccgacgaacgtcaccttcgtcaatccacaaacccaaaagaggcccgtttccccaaccaaaaccagggaaacgggcctctttaactgcaaaatccaagcagcagcaacgtctcttgaactacgtagccatcaatgcccaggcaacgccagcaagcagcacaaaacacgggattcaattctgcagcttgcgccgttgaactccacgagcctgcccgtgtagacgagcctgtccacgacagccgccgccatcttgtcgtcgccgaacacggtcacccacttgctgaactctatgttggccgtgacgatcatgctctgtctgccctccggcaccgacatcacctggaacagcagcctcgcgccctcgatgtccagcggcacgtagcccagctcgtccaggatggggagttcgcggcgggggcgacgctctccgggctgctgccgcgtatctcgcggcgtagaaaggagtgagtaccatgaccagcggagaagaagatttacctcgccgtggcgggcgggcttattgccgcgggcatcgtactcgcgggcatcggctttatcgcctcgggccgcgatcaggccgtgttcacgacccaaatcgacatgcgtgacaacaccatcgtgctcggcggcgtcgaggtggacgaacccgagggcatcccgttcatcagccggctcgccattcttggcgagatcgacacctccgacgtcgccgaccccgccgcgccctaggcgcaacgagcccgggcactccgtccgctaatttgattgagatggatcgctcctactacgcgagcattgaggtcgggcagcgcaatgtcagcctttcaaatctcaacaagattgccgacggctttcacatcaccatttcggagctcatgcgcggtgtcgagtagatgattctcatctgacttggctcgttcatgtttaatctgtctcgttaaccgaaatatgcaaatctggttaatcaaaaaattgaaatctggttaaatgaaaactgtaaatttggttaaacgcgctggtaagcaatggtgaaaactatgccaaaaaagtactacactagaattatcgaaaatgagcttgaccagatgcttgggatattcggtgccgttctcatcgaaggacctaaatggtgcgggaagacaaccacggccgggacccgtgcggcgtccaggctcctcctcatggacccgtcnnnnnnnnnnnnnnnnnnnnnnnnnnnnnnnnnnnnnnnnnnnnnnnnnnnnnnnnnnnnnnnnnnnnnnnnnncggacccggcgcttgccgtttccggcgaggtgccgcggctgatcgacgaatggcaggaggttccgaaactttgggacgcggcgcggtttgagtgcgacaaccgcggcggcgagcctggccagttcatatttacggggtcggcgacgccgcgagacaatgagcggccgatgcacagtggcgctggaaggttcgctaaattgcgcatggacaccatgacgcttttcgaacttgggaaatctagcggtgcggttaagctgtcgggcattatttctggcgaaaagttcggttgcctgggtatctcgcgcagcgactttatcgtgagcgaggacggccccgttatcctcgagaccaatacgattccgggtatgaccgatacgtcgctgtatccggatgagattcgccatacggacgatatgacgttcccgcaggtctgtgacagcctgattcgcatgggccttcgccgagcgggcattgcatgctaatcaaggacgccgtatcccctggaacaccgcagtttgtcatcgattcctacgccacgcttgccgagcgtgccaagacgcagacgttcgggcttatcgaggaggatgtcatcgtcctcgacaccgagaccacaggtctttcggtgcaagacaatgagttgattgagatttccgcggcccgcctttcgggccgcgaggtcgttgaccgctttgatacctttgtgcatcccaagcagctgattcctgccgagattaccgagctcacgagcattacgaacgccgatgtggctgatgctccgtcggccgttgacgccgtggccgctctcgccgattttgtcggcggctgcccggtcatcgcgcataacgctaccttcgaccgttcgtttatcgagtcggtcaagggcggtgtcaacgtcagcgatatttggatcgattcattggcgctgtcgcgcattgcgcttccgcgcctggcgtctcacaagctgtcctttatggccgacctgttcggctgtgactcggtgtcgcaccgtgcgaatgccgatgtcgacgccctgtgtggggtatggcgcgtgctgctcgtggcgctcaccgacctgcctcagggccttatgacgcgcctggccgatatgcaccccgatgtgccttggtcttatcgtcccatcttctcgtttttggcgggtcagaacccgggctccatcttctcactcagcgccgcacgcgccgnnnnnnnnnnnnnnnnnnnnnnnnnnnnnnnnnnnnnnnnnnnnnnnnnnnnnnnnnnnnnnnnnnnnnnnnnnnnnnnnncgtggatgccgacgaactgccggtcctcaagatgccgagccgcgaagaaatcgaggcggattatgctccgggtggcctggtcaatcgcatgtatcccacctacgagccgcgtgatgagcagattgcgatggcactcgaggtccgcgatgcgctcgtcacgggtacgcaccgtgtaatcgaggcgggtacgggcgtcggtaagtcgatggcctatctggtgccttttgccgaggctgcacgccgtaacaacattaccgttggcattgcgaccaaatcgaataatctcgccgaccagctcatgtaccatgagctgccaaaacttgccgaacaactggacgccggcctgtcattttgcgccctcaagggctatgaccactatccgtgcctgcgcaagctcgagcgcatgagtcgcggccaggtcgagatcaccaccaagcgcgatccggctgacacgctcacggcagttgcggtcatcatggcgtacgtgtgccagtcggcagacggcgacctcgattcgcttggcattcgctggcgcagcgtcaatcgtcccgactttacgacggcctcgcgcgagtgtgcccgtcgactatgcccgttcttccccgacaaatgtctggttcacggcgcgcgtcgccgtgcggcgcatgccgacgtggtggtcaccaaccactcgctgttgttccgcaatgtcgctgccgagggtaggattttgcccccgattcgccattgggtagtcgacgaggcccattccatcgagcgcgaggctcgccgccagtgggcgcgcgtggtctcggccgatgagtcacgcgttctgtttgagcgcctgggcggttcgagctccggtgcgctgagccaggtttcccgtgatttggcgacttctgagggctccacgctctatcttggcctaaccgccaaggcgacatccaccgtcgcccttgcgagcatggcaatcgccgacgtgttcgatggcgttcgtgagctcggccgccgtgcccgtgggggttatgacaatgccaatctatggattggccccgagctgcgcgaatcggacgactggcatgattttatgcagtcggcacatgccgccatcgacgcgtgccgccgcgcccgtagcttgtgcacgatggctggcgcttcgccagcgccgtgccgatgcggggtctatttccaagggtgcgacgtcaggtgccagccgccgcagtattcgcatttgtagcaggccaaaccacgccgtccgcggttttcgcagtcggccataacggcctcggcttcggcgcgtgtgtcgtaacggtttttgcgctcgcacgacttatagcgccaagcctcgtcgcgctcggcgtccagggcgtcgcggcgctcgtcctcgcgtgcaaacaggtcgctcatatcgccgccggtggcagcgcccaaaaactcgcttttggcttttgaccaggcggctcgctttttgctccccatctgcttcgcgctcctctccaaacgttggtatcattgctcaatcaaagtgataccaataaacgtgaggtcgccgcgtgatgatcagaaaaaccctcgataccgacattcccgccgtcatggctatctatgacgcggcccgcgcctttatgcgcgcgcatggcaacgccacgcagtggcccgagggcacgccttcggccgagcagctggctgccgatattgccgctggtggcagttacgtgtgcgaagtcgacggccgcgtggtggcgacgtttgcctttttaccgggtccggacgagtgctatgacgtgattgaggacggtcaatggcgcagcgacactccgtatgccgtgctgcatcgcgtggcatccgacggcaccgtgcacggtatcgcggcggcgatgtttgcctttgccaaggaatgcgccgaccatctgcgtattgacacgcacgaggacaacttgcccatgcagggcgccatcgccaaggcggggttcgagcgtgtcggtatcgtctatgtgtccgacggcacggcgcgtgtcgcgtttgattggctgcgcgaggcgtaggagccaaggcacgtatcatcacccagctcaaataaaaaatggccccgagtggggccatttttggtaaaacgcgtcgttgtgggactcgcattgttaccgccccagatgaacccgggcagacaaaaaggggaggtgccggctttcgcaaggcgcgaacctacgaaaatcgccgcgcggcaacgcggggcgatgagctcggtcgggggatagggcccgcttcgcccaccggcccgtaaattgtatcatccagtgtggagcgtgaacgcccgttgccgcgtgcgatgggcttgcaataagaggagagccatgtcgaagcaagcggtcgttggaatcttggcgcatgtcgatgccggcaagaccacgttggccgaggccatgctgttcaacgcgggccgcattcgcaagcgtggccgcgtggacgatggcgattcgcatctggacactaacacgatcgagcgcgagcgcggcatcacgattttctcgtcgcaggccgtgctcgaccacggcgatacccacgtcatgctcgtggatgctcccggccatgtcgatttttctgccgaggcggagcacacactgcgtgccctggactacgcgattctggtggtgggccttgcacgctatgacatcccgacgttcatcttcatcaacaagatcgatttggagaatcccggccgcgatgttttgctggcacaactcgggcagcgtctttccgagggctgcctggatgccaacgagctgctggcgggcggcgccgttcaggaggacgctgctgcgttggacgaagcggcgctcgaggagtttcttgaggcaggcgagctttctgtcgcaacgctgtcgcgcatggttgccgagcgcaagctttttccctgctttgccggctcggcgctcaaggaccaaggcgtggacgagctgctggatggcatatgcgcgctgatgcgtgaacttgggttaaagtgaccggcggcacgctgcatgccaaacagctgattaacggacgttccggcgccgaggcatgggagcagaagatcgaccaggtgcgcatctataacggcgagaagtatgagcttgcccaagaagttgctgctggcggtatttgtgccgtgacgggtcttgcgcgcgttcgcccaggggacgccctgggtgcggagcccgcgggcgttctttaccgagtgcgccaaagagggcacgcccacggtctacctgtgctttacctcggcgctgtcgtcgagctacaactccgcgtgccaggcggcggacgccgtgcgcgccgagtatcccgattttgagctctacgtggtcgacaacgctctgccctgcgcgaccggcgcgctcttggcgctcgaggccgtgcgccagcgttcggcgggactgaccgccaagcagctggtcgattgggcaaacgaggccaagacctatgtccacggctactttacgctcgagagctttgacgcgctggctgccggcggccgcattccgcccgcggcggcgcagctcacggcaaagctcgatgtcaagcccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaggaaggctgcgccgacatcaccatcatccgcagctccgtgggccccaccatcggttcgcacgtgggccccggcatggtggcttgcgcgttttggggcaagaaccgcgccgagaaggcctcgctttccgatcgcatcgcgcgccgtgtgcgtggcgagtaggcaggcgctacgaccacaggcgccccgcagttcaagcgctggcgccgagtattcaacctggtaacaacacccaacccaaaaggaaaggtttcatggcaaacaagctctccgtcgcattcatcggcaccggaatcatgggtgcccccatcgccggccacatcctggacgccggctatcccgtcacggtcaacaaccgcaccaagtccaaggccgctgcactcgtcgagcgcggcgccgtctgggccgagacgccggccgaggccgcggcaaacgccgatgtcgtctttaccatggtgggctatccctccgaagtcgaggagctctacctggcgggcgacggtctgctggcctgcaccaagcccggtgcggtcctgatcgatctcaccacgagctcgcccgagctcgcccgcgacattgccgaggccgcccaggtctccggccgcatggcgtttgactgccccgtcaccggcggcgagtcgggtgcgatcgccggcacgctcacggctatcgttggcgccaccgagaacgacatcgccccggtccgcgacatcctggccaccttcgcggccaacatctgctgcttcgatggtgccggcaagggccaggcagccaagctcgccaaccaggtgtcgctgggcgcctgcatggtcggcatggccgatgccatggcatttgccgagctcaacggcctggatctggagaagacccgcgagatgatcctgggcggtaccggcaagtccggcgccatggagagcctcgctcccaaggcgctcgacggcgactacaagcccggctttatggttgagcacttcattaaggacctgcgcctggcactcgcttacgccgacgaccgcgagctcgcgctgcccggcgccgacgtggcctttacgctctacgacatgctcgacgccatcggtggcgccaagctgggcacccaggccatcacggtgctctacaaggaggaggccgacgccattgccgccggtctggactggtcgcagtatcgccccgaggagcacggtgcccacgaggacggctgcggttgcggtgaacacggcgacgaccacgagtgcggctgcggccaccaccacggcgaggaccacgagtgctgcggcggtcacggccacgatgacggccatgagtgctgctgcggccatcatcacgaggagtagcgcccatgagctggacgttcgtggtgctcgcgctggtgctctttatctttgcgatctacattggctttttgtgcggccagtgggcttgcgaaaagcgcgtgatcaccaagcgcgactactggatcgccaactttgcgggtgcggcggcagtcatcctgctgacctgggtgttctcgctgttcccgctggtgcagtttgtcgagttcctcggccgagtgctcgcgcgtggacagctgcttaagcaggcggcagagcagcgtcacatagggcaggtcctcaaacgcgacgcagctcaggtcgaaatactgcatggcgtaggccaggcggttggtagggatgtcgtggcgcagacaggggatgggcgcggtcgtgtccacgaccagtgacggttcggggcgcgcctcgccaatgtcggacacgcgcaggcgcggcagcgtggccttgtcctcgggcgtgtcctcggcttcctgcgcggcacgcagcgcggccgtgcgctcgaccacgtcggccagctcggaatcggtcatggcgtcgcgcttggctgccagctcgatggcctcggcaccctccgaaccctcggcggcgtccaccggcaccagctcgacgagcgccatgtgatcgttctgcagcaccagctcgcgcagcaggtcctcaaaatagctgccgtccagctcgcctcgcagctcctcgtacaccgggccgtacttgagtgccagcgtcgcggcgtcgtcatcgtagagccaggtgctcagcgcgtcgcacgcaatggccacgccgtcggcgatgccgtagtcgcgctggcgcagatcgtattcgttgctgctgatgatggcttccaggcgctcgcgcggaacgccgtgctcgaacatgcgacgcagctcgcgcgccacgccgggctgcgcgttttgcagcatgatgagctcgtagggctgcaggctctcggccgcggtgtagctcaccacgttgccgcccaggccggcggccagaatggccttcttaaccggtgcttcgttggagcccagcagtgcctcaaacaggatatccgccgcgatcgtgcgcttgcggtcgagcgcgctgcccagcaccagacccaggcccaccagggcgttctcgggtgtagtggccatctcgacgcgcttgtactcgcaggtcacgggcgtctgcacgcccagcggattgggcgccagcgtggacgggtcctcgccggcggcgacggcagcgtccatgcggcggctcgcggcactcggctgcgacagatagcgctcgtccaaaaaggccagtgcgcggtccacgtccaggtcaccgtagagcgtgatgtaggagttggaaggattgtagtgacgcgcgtgcgtgtccaggaactgctcgtaggtgagcgcgggaatcgcgcgcgggtcgccgccgctttcgtgcgcataggcggtgtcgggatagagcgcggcgttgacggcgtcgtccagcacgctcatgggatcggacagcgcgcccttcatctcgttgaacaccacgccgttatagcgcagcgtgccctcgcgcaggctcgcggagctgtcgctgccctcgatctcgacgctctccggcaggtccagctcgtagtgccagccctcctgctcaaaaatggtgggcttggtatagatggccgggttgaacaccgcgtccagatacacgtccatcaggttgtacagatcctgctcgttggtggtggcgacagggtagatggttttgtcggggtaggtcatggcgttgagaaacgtctgcatggagctcttgatcaggtcgacgaacggctccttgacggggaacttggccgacccgcacagtaccgagtgctcgagaatatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagtgccgggcactagcagcgcggcggcagcggcgcgcgggtcggttgaggtggtgggcatatgcagtctcctttgacgccccagcgggggcgaatcgagtcgaatcctcgagagtatacccatatggggccgcggcactgcggcgaactggagacgatgccggctgatcgtcgatcactcgcggttcgcccgccgcacgagcgtggatatccggtagttcaatgttcaattgttctgctattccacagaactatgtaataacgacattacgtaaatacggcattgctgaaaaagtgaataccgttgacactccccgtaggtgacatgctcccatccaccttgcaacttcgctgctagaggtgggggcttctcgctcaaggcaaccgatgtcgccagtatcgacgagctatccccgtgtgccccacggtttcgcttcctctaggccgaaagcgcgagcctcataccttcgtccctgatgttccgagcagcgttaacgtcgcggtcatgggtgcgaccgcacaaggggcacgtccactccctaaccgacaggtccttggttcccgagaagcggtagccgcactcatgacagagctggctcgacgggaacagccgaccgacggtgacgagacgcttgccccggtcttcgagcttgtagccgagaagggcgcggaacatgccgaagccgttgtccatcgtggacttgccgagcttcaggctccgggacatgcccctcatgtcaagattctccacgcacacgcagtcgtagcgctccacgagtccgttcgccgccttgtggtggaaatccttcctctggtttttcatcttctcgtggacgcgtgcgaccctgagcttctgctttcgccaattggcggaacccttctgcatccgggagagctttcgctgctcacgtgcgagcttcctttcggcatgtcggaagtatcgcgggtatccagggcgctcgccgtcgctcgtgacgtagaggtcgtggctggagtagtcgaggccgacgaaagactcgggtttgacctgctcgggttcttgggtttcgaactcgaacaggacggacacctcaaacctgccagacctcgtgtgctcgaccgtgacgctcttgatcctccacgacgggtctatctcccttttctgcctgaccctcacgctgccgagcttgggtaggcgcaggtagcgctcgtccccctcgaagcggatgttgccgtttacgaagttggtcttgtagcagcagcggctcctgtgcttcgccttgtatttcggaaaaccgtgcttctccccggccttcacccggcggaagaagttccggtaggcggcgtcgaggttcagctgggcgttgcagagggcgaagctgtccacctccttgagccaggggaactcccgcttgtatctggcaggggtgaccttcagcatctcgcccgtcttctcgtaatgggcgatcttgtcggcgagcatccggttgtagacgaaacgggcgcagccgcacgtgcgctcgatgagagccgcctgctcacgtgtcgggtaggcgcggtacaccactgccttgtgcatcgtgaccgtcatttctgcccctggctctcgatgtaacggcggatgacctcgatgggggctccgcctgtcgtaagcaggcagaagctcctgctccagaagtactccttccagagcttgcgcctgatctcgtggaactccttcttcagtaggcggctgctcgcgctcttgtaggcgcagatgaacttcgacagctcggtcttcggctgggcgcggaacagcatgtgcacatggtcgacatcgtggttccactcctcaagggtgattccataggtcggtgcgatgcgctcgaagatctcccgggcgcggtcggataccgcgtcggtgatgacccggcggcggtacttcaccaccagcacgagatggtagtgcatgagaaacaccgagtggttattcgactccaactccacaggtagcaccacctttcgactgattacgacagatggcgtccttatacccgtgacgcggaaccccgattcatctcccacctacttttcatttagaggagggagaatcctcggggttctagttgaaaccaggggttttacgacggttttgataatctatgtggtcaatataatgccgttgaacccgcatatcgataccgctcagccattcgcctcgcccccgtcgcacgtatcttcatccggtctgttacttttaatctaacaattctttgaggaacgtaggtgcttctaaatgtatgttgcagcggaacatggaggtgctgcccaccagcacggtgcccgcgatgatggagccgttcttgtcgtatatctggaagccgttggtggcgttgatatagaccctgttgccgttgctgtcggtcatgaagatggagccgtcgcgcaggtagaaggccccgctgtcgaggtcccagtacgagttcccgcctttgatgcggcccgtggtcagctcgtcggcggtcacgccgtcgccggttatggccgtgcgccacttccacgcgccgctggagtacttggagttggccacgccgatgattccgccgcctatcttgacgcacttggtggcgctctcgggctttttgtcgtacaccaggatgccttggccgggctcctcgtacacccagccgcccgtggtgtcgctgttgagcatgccaacgatcttcttgcggatatccgtcggcagctggtcgagctgtttctgcagcccatccacctcgccctcggcgctcgtcagccgttcgtccagcttgcccgtgacgccttccaggtactccttgttggcctcgtctatctgcttgagcacgctctcgctttgctctatcgacgtgtcggtgtacaggcgcagcacctcgtccaggtccaggttgccgtcgtcggagtacttcttcagtgcctcctccagcgtggtgtccccgttgtcggcgtactccttgagggccttgtccagctcgtcccttatctggtcggtgtagtcctgggcggcgccgccgacctccttggcgtacgccttctggcgctcctcggcggccgccaggctctcgccccatttgccggtcgatgccttgttcgaggcgttcacggcctcggtcacggtcgcccggatggtcgaggcggtggacttggtggccgacttctgcgcggccatcagctcggcgaccgtctggtagttgccgaacgtgtaggtgacctcgccggggcgcagctgatcctccaccaccttggtgatgcgggtgcgcacgcgcagcggcgggtcgtacaccttgtccaccacggtcaccaggtcgccctcgtccgcgccctcgaagccctcgccggcgcgcgcaagcgccacggcgtccacggtgtaggacacggtgggcacgcacnnnnnnnnnnnnnnnnnnnnnnnnnnnnnnnnnnnnnnnnnnnnnnnnnnnnnnnnnnnnnnnnnnnnnnnnnttcagctcggcggtgtcctcgcagtcggagaactccacgtcgccgaacacgtgcgccttgccgcccttgccgtcgggccgtccccagcgcgccagcgcgtcggccgaccccacccagttctgcccgccgttcacgtcgccgaaggtcagcttgcggtcgtagccgcccgtcaggttgccgtcctcgtcggcggtctgcagggacttgccgtagccgtacagggcggtgcacacgttgccctcgtccacgctgcgcttgacgctcacgaggtccttggcgtaggtgaaacgcttgccgttgtcctcgccgacctgcttggccatgcacacgcggcgtgcggtcaccttggtgccgctcacctggatttcgaacgacagctcgccgccccaagtgtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgcccttgtccaggcgcgccagcgttgtgatgctcagggcgttctcgccgttgacctcgcgcgtgtcctcgcactcgaacagcgtcttgatgggtcccttgtacgcctcccagcggtcgcatacccacagaatcatcagcccacgtacctttccgtccactgtaccgtcgcggtgccgctggacagcttgaggctgttggcccccggctccagcgggaagaatacagcaccgccgagtacaccatcgtgaccaccatcgccgacaagggcgacggtacgctcgaggcgaagcatgaactgaagggcgccgacgaggcgaagttcaccaactcctacaagcctggttccaaggactccagcgtcaccgacaagattaccgcgaccaaggtcctgaccgggcgtgagtctggcctcgcggccggcgagttccgctttgagctcgtcgaaggtaacgttgttgtcgctaccggcaccaacaatgccgacggcaagatcatgatggatcccgtcacgtacaccgaggtcggcgaacacacctacacgctgcgcgagtccaaggccggtaccatcgagaacggtgttacctacagcaccgccaagtacaccatcgtgactacggttacggacaacggcgacggtaccctcagcgtcgagcataagctgcagaacgccgagaaggcgatcttcgagaacacctacaagccgaatcctggcaagtcgagtgtcaccgacaagatcgcggcgaccaaggtcctggccggccgcgacctcaaggccggcgagttctccttcgagctcgtcgagggcaacgacgtggtcgccaccggtgccaatgacgccgacggcaacattgcgatgggcgagatcacctacaccgaggccggcaagcacgcctacacgctgcgcgaggtcccgggcgacgccggcaatggcatcacttacgacagcaagacctacaccatcgagacgaccatcaccgacaacggtgacggcacgctcaacgctacgcatgagctgaagggagccggcgaggcgaagttcaacaacagctataagccgaaccccgacgagttcagcgtcaccgacatggtcaaggcgaccaaggtcctgaccgggcgcgacctcaaggctggcgagttctccttcgagctcgttgagggcgagggcgaggacgccaaggtcgtcgccaccggtaccaatgacgctaccggcaacatcacgatgggcgccgtgaagtacaccaagcccggcaagcacacctacacgctgcgcgaggtcaacggcggaaccatcagcaagggcatcacctacagcgacgccaagttcaccatcgagaccaccatcacggacaacggcgatggcacgcttagcgccaatcacgagctgaagggcgacaaacctgcgaccttcgagaactcctacagcgtgaccccgaccgatgcagacctcgactttggtctgagcaaggccatcgacggtcgcgagtggacggatggggacgagttcagctttaccatcaccgctcccgacggcaccccgctgcccaatcctgcaaccgtaaccgtgagcaagcgcgacacgaaggacggcatcgccgccatcaagttcggcaagattcgctacacggctgccggaacctacaagtacgagatccgcgagaacgcgggcagcacggtcggcatgacgtatgacgcccatgtcgcggccgccgaagtgaccgtgaccgaggacggcgagggcaaactgaccgccaacgtcaccaagaaggaaaacggacgctttaccaacacgtatcgcactgagcttaactacaccgcggccggcggcctcaagctcagcaagaccctctccggacgtcccatgaccgagggccagttcacctttaccgtgacgcccgccgacgaggcttcggccaacgcgcttggcctactgcccgtcgccaacgaattcaagtcccccgcgacggcagagggaacggtcggcctgattgacatcctggctggccatgaggtcaagtttacgcaggctgacgccggtaagacctttacatacaccgtggccgagaagaacgacgaccagcccggctacacctacgacgacgctgtccgcaccgtgacgatcgctatcgccgacgacaccgccggtacgctcaccgccacgacgactgtttctggcggttccgagggcacgctggtgaccgagtacaagactggtgccgctgcggtcgagagcgccgtggtcccgttgccccaggccagcggcacagacctatcgccagagcagcaagatgacgctgagcttgcaagatacgcgaacgccgccctcgccgctcaaaccgacgccgcctttctcgactctgccgagagctactacgcgctcatggacgaaggcttccaatccgggtccatcgtgggagaccgagagaccaatgacgcagacctcgcgtattgccgcgctctgagcagctccggcatcacggatatcccagcctccgcaaacgacctgccattcctttccttcctgccttacgccattgcccaggcgccgtctttccttcccttcatccccttccttctctcgtcgatactcgtgctcggcgccacaaggcccgggaccctggcggcaaaggcgcccgtgcccaaattccggcgccttatccaaaccgtgttttcgataatcgtcgcggggaccgcgatgctcctcgccggcctcgcacccgggggcatttacgccttggccctaaacggcttcgggcaaattgggtacccgatcgccttcttccatgacggcgcgctcactaccacgaccgcgggaaacgtcttcacggccctgcttctcgcgctgcttgcgggcggaaccttgatatccgtttgctccgccgtcctatcgaccgcaacgaggcgcgtcctcgcgggcccccttgcctccgcgctgcttgtcgcggccccggcattcccgttattgtccgattcggcactggggcataatgccgcgctcgagctcctgccgctggccgtgttctcgcctatcgaggcaacgggctacgtgggatgcttcccgacggaattcattggctccggttcaggcagcgcatcgatgcttgccgtggcactgatatacgtcgcggtcctttttgcggtcggcgccgttgcggcacgttcgcccaaacaggctggacccgctaaaaagcaccatgggctcgagcttctggacgcgagcgtgggatacgggagcacgacgatactttcaatcgggtcgcttttcctgagcccgggaacggcggcgggcctcgttgctcccaacggctcggggaaaaccaccctcctggaagcgctatcgggccaatttcccacccgcatccgctcgggaagcctgttggcagacggaatctgccaacgtcgatcagccgaattcgcagaactcgtctatctgagctcttcgggcagcgcggatctctaccccacgctatcggccctcgagcacctctctttcgttagggaggcgtggaaatcggccgccgacatcgactcgctctgcgactccctcggaatctccccatatctcgacaagccgacccgtaaactctcgacaggaatgaagcagcaggtaaagcttgccatggcgatagcgaccgattgcccgtacctcatcctcgatgaaccgctgaacggcctcgatccgggaaaacggaaaacctcctgcgacgcgatgcgcagcgaagtggcgcggggacgcagcgtgctcatttcaagccatctactcgacgacctggcagacctcaccaactcgttctacttcatcgaagccggcacgctcgtggaaaagatcaagtcgtcctcgcagacgctcaagcaggaatacctcgatacatacgagcgaggtgaatgacatgaaacaatttgaacagctgaagtccaatgcgtcgcgcatggctgtctacgccatcctcgtggcaacggctttatgcggaatcgcggcacccgtctatgcgctcaacggaaagaaaggcgatgtcgagcctctgtacatgagctcgacggttaaggaccggtacaaagccttctctggagacgcgttttacgtagcagagtacgacacgacctaccgtgagcttcgctacaacaagagatacgaatatctaggcgcaaaagcaatcagctatacatcgggttggtacggctcccactatggacacataacccagttcaatttacttgcgccgatacgtgggagatctttgtcaacgacgagcccgccggcaccacgaacacggtcgagacctatgtcgacggtctggttcccggcaagcgcaacctgatccgctttgtttgcagcgagcgcgagctgagcgtgggcgtcactacgccggcagagcctttcaccattaacgttcgcgactgcggcgccaagggcgatgccgagcacgacgacaccaccaacatccaggctgccatcatggcctgccccaagggtggccgcgtgctgatccccgccggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgccgtgctgctggcccgtcacgaccgcgcggcgcttgcctacatccccggtacggtcaagggcgacgagggtgccggttacgccggtaccgacatgaccccgctgggccgctgggagggcgagagcttctcgacctattgctccacctttaccggcttaagcgtgcacgacgtgtgcatctatggccgcggcgcgatcgatggccagaccgattttgctgaggacaactggtggaacaaggactttaagaacatcttccgtcccgaggagggccgcgaggtcgcccgtccgcgcatgatcttcctgtccgagtgcgagaacgtgagtctggtcggctttaccgtccgcaacagcccggcatggaacatccaccccatcctgtgcgagcacgtcgatgcgctctgcctgtccatcgagggtcccaagaactcccacaacaccgatggcttcgaccccgagagctgcggctttgtccgtatcctgggctgccagttctcggtgggcgacgactgcatcgccatcaagagcggcaagctgggtattgagcccgagctccgccccgcaacgcacgacgtgctgatctcgcactgctacatgcacgatggccacggcgccgtggtcttgggttccgaggcggccggcggcatcaaggacctcaccgtgagcaagtgcctgttcgagcgcaccgaccgcggtctgcgcgtcaagacccgtcgcggtcgcggtaaggacgccgtcaacgagggcatcaccttcgagcacattcgcatggacaaggtgcttacgcccttcgtggtcaactcgttctacttctgcgacaaggacggcaagaccgattacgtccagaaccgcgaggcactgcccgtcgacgaccgcacgcccggctttggcgccacgacgttctgcgatatcgaggccaccaactgccatgccgctgcggcctacattacgggcctgcccgagagcaaggtgacgcgtctgacgttccaggatgtccatgtgacctttgccgccgatgccgagccctttgtgccggccatggcctgcggcgtggagcccatggnnnnnnnnnnnnnnnnnnnnnnnnnnnnnnnnnnnnnnnnnnnnnnnnnnntcgacctgcagaacgtgcgcatcgagggtcaggatggcgacgagctgcagctgcaaaacgtcgacaaggttatccgcgcgtagggtagtgctcctgcacaagtgaatacggcatgttgaggcgtgcgacggtcgggtctgcccggctgtcgcacgcaatctataggtgccggcattgcatggtgggtgttctgtgacagaaagcgtaatgacagatgagtggtaaagagcagctctttgaggtatcgctcgaacgcgaaggcgcgtatcgcagcatttcggcggcgctcgaggcggcggagcggtgcgtgtccgatacgaccgtgccggtgcgtgtgctggtggagccgggcgagtatcgcgagcaggtcgaaatgccccggtctcttgcgaaaagtgggttcgctccccgcttctgcacatattccgaaccgactgggcacccccaggtataacgtattggggtgcttttgagaggctgcccggccaagcacatgaagagacggtcgccgaaaccatcgattgttgcgcgacatatgacgccgcatgaagaaccgacatgccaaccgacaccgcccaaagccatcaggccgagcaacggaagtggagtgtgtgcgtggctggagagagcggaatcaagaaccgtcgtggcgaactgcaacgagtgctgagccaagaggaatcgtacgttgacggcaagctgagtcatgccgcgtttatttcgatcgcaatcctgaccttcatcacctttgtcggcaactttacccagctgcaactgagctcggcgctgccgatcatcgtgtcggaattccatatttccgtgaccacaggccagtggctgacctccgtgttccagctggttatgggcgtcatggtaccgctgaccgcgttcctgacccgtcgtttctccacccgtcagatcgtgatctgctcgatggcggtgttcacggtcggctccctgcttgcctggctgggcccgaacttcctcttcgtgctgctcggccgcgtgctggaggcagccggcacgggcgtgatgtggccggtgctgcagatcacggtgttttccatctacccgctttcccgtcgtggctttgcgatgggcaccgtgggcatggccatgagcgtggctccggccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggtgtgcctgtcggtgatcggctttggtgggcttatgttcggcttcaccaattcagagacctatggattcgcggcaccggtcacgtgggggcccatggttgtgggactggtcggcattgtctggttcgtgctgcgtaacctgcgcgctggcaagcggtatcgcgaggccgcagccaaggacgagtcggcactcccccagccgccgctgctggacttggaagtgctgaagaaccgttcgttcaccgtcggcaccattaccgcgtcgctggcatttttcgcgttcagttcgattctggtcatcatgccgctctacatccagaccgaccgcggctattcggccacgatgagcggtctgatcatgctgccgggcgctatcggccagtgcgtctcccagttcttcggcggccgcgcgatggatcgattcggcgcgcgcccggtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcgacgcctccgccgtcgccgcttcgattttcggcattcaatgggcgctgcgaatctccgcaataatctgtctggcaatggtgttgatggtgttcttcggcgtcaagggcgacggtgccggtcgtacgcgagacattatttccttgcgcgcgctgcgcgaacggcgtgcgcggcgtatggctgcgaactgacggcagattcaaccattctcaacataataagaaaccccggtgttggaaccggggtttcttattatgttgtgctatcgcaggattaccgtgccgccatggacacgatctatcgccagctcgagacccagccgcgtaccaaagagggtgtgttttggcacaaggccgtctatcccaaccagatctggctcgacggcatgtacatggcgcagccgttctacatgcagtacgagctgagcttccacaaccgccgtgcctgctcggatagcttccatatgttccaagtggtgcacgacctgatgcgcaaccccctcaacggtctgtactatcacgcttacgacgcgagccgcaagcagttttggtgcgatcccgtcaccggcctttcggccaacttctggttgcgcgccgagggctggtttgccatggcgctcatcgatacctgggagctcatgccgccctcgatgtcggcggaaaaggacgagattcgcaagatgttccacgacctgattgacgctatgctgccgtatcaggatgagaagaccggcatgtggcaccaggtcatcaacctgcccaatatcgcccccaactatctggaggagtcgggcagcgcgatttttgccaatgccatcatgaagggtgtgcgtctgggcgtgctgggcgagcgttactaccagtacggccgccgtgcgtttgacggcatctgcgacacgtgcctgtccgagcgcgacggacagctggcgctcgacaacatctgcctggtggcgggccttggcaacaccacgcaccgcgagggcacgtttggctactacatgagcgagcccgttgtcaaaaacgacgcgaagggcgtggcgccgctggtgcttgcctatatcgagaccatgcatcatgacaagcttgccggtaagcgcgatccgcttgccccttcgggcgtgtgctccatcgacgacccgtttggcggatacaccccgggcatcaatgctcataaggggcgtgaatagcgtgggggccattactccgggcgtgcgtttacacgaccttccgcaggggaccgtcgaggaacgcattcgcatggcaggagagctgggcttttcgtgcattcagctgccgagcaaggtgctctacgcatcaatgggaatcgatcgatgcggtctgacccgcgagctcgccgaccacctgtgcgaggtgctcgacgaggcagacgtttcggtcgccgtgttcggctgctataaaaacctggcgacccccgatcgtcaacagctcatggataactttgccgagtacgaggcatgcctgaactttgccaagatgctcggcggctgcccggtgggcaccgagaccggtcgccccaacgtgcagaataacgtggcggacgatcgcatgaccgacgaggcgctcgatgcgtttgttgagggtctcaagtatgtctgtggtcgtgccgaggcaacgggcggtcagattttgattgagcccggctggaacgagacggtcaacacgccccagcgttgccgcgaggtgcttgagcgcgtgccgagctcggcactcggcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgtcgttgcctgggctgccgctgcctgcccgggcattccgtgtgtggtcgagaatagcgtgccggcgacagcagctggttgtctgacgacgctcgagcgtatgtctgcccgttgcgaaggcgcgcatcgggagatgtagcgtggccgacggtcgctacgggcggacggctagacggtactgggcagcatctggaactgcccgctattgtgttgatgcaaaggcagttcacggcgcttgccaacctgatcgagcgcatgaaggctgctgacgagggcaccgcctccaagaccgagtggtggcccgccccggagcttaccgactggatttatagcccactttcgggcgccgacgccgccagcgcgcgaaccttcgataagaacatgcgcctgtcgcgcagcaagaccactgcgggcgtcaagagtctgctacagagcgtgcagggccaagtgaggggtgcgcgcaaggcggccagcgaccagaactggtttaagaacgtgccgtgcgtggtctcggatgtgttccaggcgctatggcgtgacaagcccgtgacggcgctcaaggccatgctcgcggttgccgaggcgctgcccgatcgcgccctgggcggccttgacggccgggcccgtcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcgcagtaccgcttacgattacgagacctacgaggtcgaccgcactccgcgcgcccaggtgcgattcgcgtcgcttgccgatgcggcggcgctgcgccccgccagctacgatgccgtgctgtttgccgatgtcgacctggacagttatccgctttcgcatgaggagggcccgttggccacgttgacggaagagttgggtcgcagcggcgtgacgcttgagcccgcggccctgctgcgcgtgcgttttggccgtgcgatgcaagcgtcgcgtggtccggttacgctcgcccgcgtgacccacgatcgccaggcgcgcgagtgctacccggcggccgtgtggaccgagttgcgggcgcgcgccaaggccgctgacgacgccaaggccgctggcgctgacaaggccgctgacgccgacaaggtcaccgccgccaaggcgacgtgcgtgggcgagggcgnnnnnnnnnnnnnnnnnnnnnnnnnnnnnnnnnnnnnnnnnnnnnnnnnnnnnnnnnnnnnnnnnnnnnnnnnnnngcatctgagcgccgaggccgtgccgtatctggttttgcgccgccgcgatggtgagggcgaggatgcgccgctcgtgccgcgtttaacgtccgcctcgcaaatcgaggcatattccacctgcccgctgtgctggtttgtgtcctatcgcgtaaaaccccagtctatcgatgcaggctttggcaacatggagaagggcaactttgtccatgacgtgctggagcacctgcatgctcgtctgccccaggagggcatggaacgcgtgacgcccatgaacctgccgcgcgcacaggagctgctgcgcgaggtcttcgacgagactctggccgagcacgccggcaagcgcggtaccgagggcccgctggtgccgctctcaccggtggaggaacgccaggtggccgagatcttgccgcagctggaggacgtgctcgcctatgagtccgaggcgcttgcgccctttgtcccgcgctatctggagtttgcgtttaacgagcttaaggtcgagtatgccggctggccgctcggcgggcgcatcgaccgcgtggacgtggatgccgagaaccgcgccgtggtgatcgactacaagcatcgttcgggcgtcgaggaatataagctcgccgaccccacggtgttcgatgagaagacgggcgcggtgcccgccgacgacccgcgttggctgccgccgcatacccagacgctcatctacgcgcaggccatgcggcgggcgctggacttgaacacgcgcgccgcgctctacttttcgaccaagggcggcaagccggcgctgcgcggcgctgttcgctcattctgtaagcatcggatttcgcaagcaacgcagggacaaaccgtgagaaactatttagcgtttatggagcgtatacgatgggagcgatgccttggataagaacgagctgcaaaagcgtatggaacaggccatccgcctgacggcacctggtcagccgatccgcaccgccctcgacatgatcatcgccggtcacctgggcgcccttatctgcgtcggcgacaccgaaaacgtgctcgctgccggtaacgacggcttcccgctcaacatttcgttcacctcgaaccgtctgttcgagctctccaagatggacggtgccatcgtcatcgacggcgacctcacccagatcctgcgcgccaacttccacctcaatcccgatccctcgcttgccacgagcgagacgggcatgcgtcaccgcaccgccgctcgcatgtcggtgctcaccgatgccatcgtgatctcggtctcggcccgtcgtgccgtcgttaacgtgtacgttcacggcaagagctacgagattcagcctgtcaccaccatcatgagctcggtcaaccagctcgtcgctacgctccagactacccgtcagtcgctcgatcgctccttgctgcgcctgacggcccttgagctcgacgactacgttacgctcgccgacattaccggtattttctcgagcttcgagatcatgcagcaggcaaagaccgagcttaaggattgcattgtcaagctgggcaaccagggcaagctcgtgcagatgcagctcgagcagctcgcgggctccagcatggataccgaatacgacctgatgatccgcgactacgcgagcgattcctccgaggcaaacgccgagaagattcgcgccgagctcgctcgcatgacgcccaaggacctgtccgacccgcagcacgtggcggcggttctgggttatgacgacctggacgaggattccgtcatgacgccgctgggcctgcgcacgctttcgcgcgtgtccgtcgtgcgcgacggcgtggccgagaagatcgtcgacgagtacggctcgttgcaggagctcatggacgacatcagcgaggatccggagcgcctgggcgactttggcgtcaacaaccctgccattcttgcggactcgctgtaccgcatgaagggcaccaaacaggggaacgcataatggcgcccgtatgcgccgtggtcgttgccggcggcagcggccagcgctttggaaatcccggcggcaagcagctcgttaacgtggcgggccgtccgctcatgagctggtctatccgcgcgttcgatcgtagcgacaaggtcggccacatcgtggtggtgtgtcctgccgagcgccgtgccgagatgcgccgcctggccatcgatccgtttgactatgacacgcccatcagctttgccgatgccggcgatgcccgtcaggattccacccgtgccggcgtgcatgcggttccggcgggtttnnnnnnnnnnnnnnnnnnnnnnnnnnnnnnnnngggtttcgaatatgtcgccatccacgacggcgcccgtccgcttatcacgaccgaggccatcgatcatgcgatcgacgtgcttgtgggcgaccgctcgctcgacggtgtcgtgtgcggtcagcccgcgatcgacacgctcaaaatcgtcgacggcgataatatcgtcgagacgccgccgcgcgagctctattgggctgcgcagacgccgcagatctttagcgttgacgccatgaagcgcgcccacaccgcagctatcgccgagggctttatcggtaccgacgattcatcgctggtcgagcgcatgggcgggcgcgtccgctgtgtccagagcccgcgcgacaattgaatatctcgtccggatgtcatatcagctcacgccgtgcgcctattgggcatcggcattgctcttctcatggccgctcaccgcagcgcgaacatggccgcgcgcccgttcaagagccgtcgcagcctgctcggcatcacaatccagcagcaccgagacgatagcggttttaacgtggccgccggcatctgcaagcgcctgaacagcgtgctcgcgcgtgcagccggtcgcctccatcacgatgttctggccgcgcaccaccaacttctcgttcgtctgctgcacatcgaccatcaggttttggtataccttgccgatcttgaccatggcaccggtcgaaatcatattgagaatgagcttttgaaccgttcccgccttgagcctcgttgagccggtaagcacctcggggccgggcacgggctcgatggcaagatctgcaccctccccaatcttcgacctttggttgcaggcgattgcaatggtcttgcacccggcagtcttggcatatgcaaggccgcccaccacatagggagtacgaccgcttgccgccaggccaacgacaagatccttgtccgagagtccacgctcccgcaggtcgctcgcgccaagctcctcgctgtcttcggcaccttcgacagccttgataaacgccgtctcgcctccagcaatgagcccgacaatcagatcgggagatacgccaaacgtgggcggacactccgaagcgtcgagcacgcccagacgtccgctggtgcctgcgcccatgtaaaagacgcgcccgccgcgctcgagtgcctcagcagcccagtcgattgctgtggcaacctggggtaacactttcgtgaccgactggacggcacgaagatcctcatcgttcatcgtcgtgacgatctgcagcgacgtcatcgtgtcgagatccatcgttcgctggtttcgctgttcggtcgtgaacttcgttaaatcgagcaatccattcacctcatctttcctgtttctcgatgtagttttgcttaatgacatgcgtcgcccgttcgtaatcgcttgcaacgtaagcggcgtacagagcgtcgacaaccatgagctgggccatacgcgaagccatggcaccgctgcggaccagcggctcacttgcggcgacgccgagcacggcatcggccatggtggcgagcttggacgagccatccactttggttatggcgttgagcctccgcggtgcagtccagcacctcttgcgtcaagcccgaatagctaaaggcgattgcaatatcgccctcatgcatgttcttggcgcacaagagttggtcgtgccagtcatcgtacagatggcactctttgtcgacacgcatgagcttttgcgccagatcgtgcgcaaccaaacgagaggcaccgataccgaacagattgaccgcgcgcgcccgcttaagataggccgcgcatcgctcaaggacggtgtaatcgagcgttcgcgctgtcgcttcgatcgttcgtacgttgnnnnnnnnnnnnnnnnnnnnnnnnnnnnnnnnnnnnnnnnnnnnnnnnnnnnnnnnnnnnnnnnnnnnnnnnnnnnnnnnnnnnngctggaactccttatagcccgcaaagcccaagcgtttgcaaaaacgcaaaatgctcgagggtgaggagaacgtggcatcggcaagaccgcggacggacagcccgaccacctcgtgcggatgagcgctcacatatgcgatgacattgcgctccgccgggctcgcgctgagctctcgctctcgaagccgcaaaagcaatccgtttgccatctcaaacacctccgttgagaagatcttcgagacctgcatctacgatttcgatacgctgcacaaccgtctgcaggagacggcgttcctcaataagaaccttaagattgtgctgaccgacgagcgcgaggcgactccccacgtggaggagttttgctatgagggcggcatcattgacttcgtcaagttcctcaacgagggcaaggacgtccccgaggcctttaaggagcccatctacatcgagggcaaatcggacccggacgctcccgtggccaagatgggcgaggtcgaggtttccctgcagtggaatagcggctacggcgagaacgtcatgtcgttcgccaacgacatctacacccccgagggcggcatgcaccttgagggcttccgcaccgcgctcacccgcgtaatcaacgattacgcgcgcaagcagaacctgctcaaggaaaaagacgccaacctgaccggcgacgatgtgcgcgagggcctttcggccgttatctcggtcaagctgcccgatcctcagtttgagggccagaccaaggcaaagctcggcagctcctatatgcgcgcgctcacgctcaagatcgtgaccgacggcctcgccgattacttggaggagcatcccaagcccgcccgcgagattgtcaagaaggcgcaacaggcctgcaaggcgcgcaacgccgcccgcaaggcgcgcgaggcgacccgccgcaagagcctgctcgagacggcgtccctgcccggcaagctcgctgactgctcggtgcgcgatgccgagctgaccgagctcttcatcgtagagggtgactcggcaggcggttcggccaaggacggccgtcgccgagacatccaggcgattctgcccctgcgcggcaagattctgaacgtcgaacgcgttggtgaccatcgtgcattctcgagtgacaccatccagtcgctgattaccgcgatcggctgcggtgtcacgacgagtgccggcgacggcggcgacttcgatatcaccaaggcgcgctaccacaagatcatcatcatgaccgatgcagacgtcgacggtgcgcatatccgcatcctgctgctgacgttcttctacaagtacatgcgtccgctgatcgatgccggctacgtctatgttgcctgcccgcccatctttggcattaaggtgcgcaacaagatccactacgtgtatcccaacggccgccagcccgaagacgagatcctgcgcgacaccatccagagtctgggcctgaaccccgacgacaacgacgaggacggcaaggccaaggacggcaagatcaccaagaagcgcaagggctataccgtccagcgctacaagggcctgggcgagatggaccccaagcagcttgcctcgacgacgatggatcccaagacccgcatcttgcagcgcgtgtcgatcgaggacgccgtggtggcggaccgtgccgtgcgcgagctcatgggttccgaggtcggctatcgccgcgagtacatcgagaagcacgcacatgacgcacgattcttagacgcctagctttcccaggcaccccatcttgcccttcaggatttcgggcgccgcacgcaaggcgtgcgccctcatccttcagggcaacctggggcacctggaaaacctaggagggttatccggtgttcccggtaatccgtctccgtggtggggaactaatggaccacgcaaaccatgaggaggtaacgtggcagacgatatcaacaacaatgagggtatggacgaggccggcgacgccggcatgcccgatgatctgaagcgcctactcgcccgcgccgagcaggcggcaccgattgtgggtggcggtcgtcgaccacaacggcttgcagattgacggaacgatcgacgaggttaactcggcaatgccgctcgcagataagttccgcgcctttaagtggcacgtgatcgagctggccgacggcaacgacatggagcaggttgcggctgctttcgccgaggctcgcgaggtgagtggcgcacctgtggccatcatcgccgagacggtgaagggcaagggcgtctcctttatggagaaccaggtgggctggcacggcaaggcccccaacgatgaacagtttgagcaggccatggcagagctcacggccgccggagaggagctctaggatggcagacgtcaagaaaatcgccacgcgcgtaagctacggcgaggcgcttgtcgagctgggcaacgagcgcgatgacttcgtggttctcgatgccgacctggcggccgccacgcagaccggcaagtttaaggccgcccatcctgagcgcttctatgatgccggtatcgccgagagcaacctgatgggccttgccgccggcatcgcgactacgggccgcgttgccttcgcgagcagctttgccatgtttgccgctggccgcgcctacgagcaggttcgcaactccatcggctacccgcatctcaacgtcaagatcggcgctacccacgcgggcatttcggtgggcgaggacggcgccacgcaccagtgctgcgaagacattgcgctcatgcgcacgattccgggcatgacggtgattgttcccgccgacgatgtcgaggcccgcgcctgcgtgcgcgccgcctatgagtttgaggggccggtctacatgcgcttcggccgcctggcgacgccggtcatcaacgaccgcgaggactatgagttcaagatcggtcgcggcgtagtcgtgcgcgaggggtccgatgtgaccatcgtcgcctgcggccttatggtcgccgaggcgctcgctgccgccgaggcgctcgcggcagatggcatcgatgccgaggtcattaacatgcacacaatcaagccgctcgacgaacgcctggttgtcgccagcgtaaggaagaccggtcgcgtggtcaccgccgaggagcattcgattatcggcggtcttggcgaggccgttgcctcggtgcttgccgagcagcatccggtgccgatgcgtcgcgtcggagtgcgcgatgtgtacggcgagtccggccccgcggtcgatttgctgcacaagtacggtttggatgccgatggcatcgaagccgcggtcaggtccgtgctgtaaggagggttttccatgggatttgtatctgctaaccaagtgacgattggctacgctgccgcctcgcgcgaggacgcgttgcattatctgtccgagcaagctgttgagcttggttttgccgacgacgcgtctgctgtagaggcggcttttattgctcgcgaaaacgaggccgagactggcctcgtcgccgggtttgctgttccgcatgccaaaagcgacgcgattcatacgccgggcgtggccgtgctcaagttggccgagcctgttgagtggccaagctttgatggtgtgcccgttgatgttgcgctcgcgctgtatgttcctgcgggcgaggctggaaccacgcatctgcgtctgctttccaaggctgccgtgatgctgatggacgctggtttccgcgacaaagtgcgcgaaagcaccgaccccgcagagattgccgagcttatcaacgccggactcgagggctagaatacaagcgcttctttatcgacgaggaccagcccgctgttcaggctgcctagcctcggcttacgaacgcctgcgcgtaacggctcctccgggagccgtttttgcgtgggtgcttttcagttactataaaaaccgtccctgccaaatggctgagaaaggcgaaagatgcaccattcggattccgcgaccgtgaccacggtcgatacgcttgccaagcttctcgatgtgtgcggcgagctgcgcgcatcagagcaggttgacgagcgtgccgtgaccggctgctcgtttgattcgcgcgcggtctcggcaggtgacgtgttcttttgcaaaggcgctgcctttaagcccgcgtttttgagcatggcgctcgatgcgggcgccgtcgcatttgtgtgcgaagagtcgctggtcgagtctctggagccgctggcgcaggagagcggtgctgcgatgctggttgttgatagcgttcgcacagccatggccctgttgccgccggaggtctacgaccgtcccgaccacgacgtcaagatcgtgggcatcaccggtaccaagggaaagaccacggccgcttttatgcttcagtccatcatcaaggcagcgggcgagtcctgcggcatgatcggctcggtgagtaccgacgatggtatcgagtgctacgagagcaccaataccacgccagaggcccccgaggtctggcgccatatcgccaactgccgtgagtccggtcgccagtccatggtcatggaggtctcgagccaggcgctcaagtaccaacgcgtcgagaatctgccgtttgacgtggcgtgcttcctcaacatcgggcgtgaccacatctcgccgatcgaacaccccacgtttgaggattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgagcgcttggtgaccgttggcgtcgagcatcccgaggcaagcctgtgggcaagcgatgtccgcgtggtcggctttaacatcgagtttaacctgcatggcctgtgtgccgacgagtccgaggcgggggagaagatcctgctgggtatcgcgggagactttaacgtggagaacgcgctggtcgctatcgccgctgcgcacgagatcggcatcggtatcgatgccatcaagaagggcctctccaagcttcgtgtgccgggccgcatggaggtcgtggagtcgaaggacggccgcgtgatctgcgtcgttgactatgcgcacaaccagctttcgttccgatcgcttttctcgtcggttaaacgtgcgtttcccgccagccccgtcattgcagtgtttggcgctgccggcggcaaggcgcaggagcgccgcgagcagcttccgcgcgaggccgcaccatattccgacctgatgatctttgccaacgaggacccggctcacgaggacccgatgaaggtctgtcgcgagcttgccgagcatgttcccgacgatacgccgaacaagattatcctcgatcgcgaagccgctgtgcatgcggcgttcaaggcggcgcgcgaggagtacgttaaccccgatgctcccaccattgtcttgctgctggcaaagggtgacgaggagctcatgcacgtgggtgacgagttcgtgcccatcgagagcgacctttcgttggccaatcgcctgatcgatgttacccagtttgataacagagtagatatgcatgttcactcctgttcgtagttgtgactatacgaacattctagaacaaacgcatactattttgagcattcgatgcgaaaaagcgccccgcaaagagcagaggcgcttctgttgcaaacgttattcccgcgggcagcgttatgcctgctgatagtgcaggtgtttcccgtcgatatcggccaggtcgcggtcgaggtagcggcgcgcgagccagtttgccatgggaaggttctggtccaggtagttgccgcactcctcgggagcggcaccggggacatcgccctcaaagtcggcgacgaactcaaagagctcgcgcacgagcggcaggatctcctcgctcgtcacctcgccaaacacgaccaggtaaaagcccgtgcggcagcccatggggccaaagtaaacgatacggctcgaccactcggcatgattgcgaaggaaggtcgcacccaggtgctcgatggtgtggcactcagccgtgttcatgaccggctctttattgggcgtggtcagacgcaggtcaaaggtggtgacggcagcgccggtcgccggatcgcggtcgatgcgactcacgtatacgccgggctcaagcagcagatgatcgacagaaaagctcgcaatgcgctccatggcagatcctctcgatagtcaatttgggacggggctcttttagctggttcgaatggtcacaccaatcataccagtcaaaaaagccccgtcccaaattagccacctgggacgaggaccgatgattatttgatccccgtcccagaaaaatcatgctaggcggtgtacgagatagtcgcggccactgcatggcgccagccggcgatctttttgtctcgctcgtcggcgggcatggcaggctccacgatgccgcgggcaccgtagacgtcgaccacgtcgcgcgtgtacatgcccagcgnnnnnnnnnnnnnnnnnnnnnnnnntcgttgctcgcgatgcggatgggcgagcccaccaggtcgctctcaaactgcatcaggtacgcatcgcgcgtgggaccgccgtcaacgcgaagctcggccaacgccgcacccgaatcctcgaccatcgcgtcgatcacgtcgaagatctgataggcgatcgactcgtcggcggcctttacgaactccgcgcgacccgtggtgcgcgtcatgccaaagacgcagccctcggcgtcgctcgcccagtgcggcgcacccaggccggtaaacgccggcacaaagtagacgcggctcgccgggctggcggcatagcacaggtcggtgacctcttcggggttattgagctccaggtcgtcgcgcagccacgtcttgacggcgccggcgtagctcacgttgccctcgagcacgtactcggtcacgccgtccatgcgccacgcaagtgagctcgaaagcccgtgcgagctggcgacgaactcgtcgccgacgttcatcatgaccgaactgccggtgccatacgtcgccttggccatgccgcggctgtggcagccctgtgcaaacaaggccgcatggctgtcgccgagcacgccgtgcacaggcacgggcgccggcaaaaagccgcccaggtccgttgtaccgaacaggccgtcggaatcggtcacctgcggcaggcaggcagtgtcgatgccaaaggcctcgcacaccggctcgctccagcagccgcggcgcaggtcaaagagctgcgtacggctggcgttggaccagtcgcagctggttggcgcgcttctcgcccttgccgttgatgacgtaggtggcggcggtgtcgcggaaccacgcgtcgtcggtggtcatctcgatgacggtgacgtcgcggttggccggcgacaggtcgttgaccagcggagccagatagtcggccgtctcgcagccgacggtgccgccgcccacaatgacgatcttcttgcccgggaaggcattgccgcccagcaggtcgtcagccgtcatgacctgcttaaagccctgcataaaggccggagcgataggctcggcgccataggccaggacaacctcgtacccggcgtagtcgcgctgaatgtcctcggccgaaagctcggtaccaaagacgcacttcacgccggcctcggccagacgacgatactggtacttaatcacgcgggtgagctcctgctttgccggcgggacggccgcgatgcgcatctcaccacccggctcgtcctgcttgtccacgagcaccacgttgtgtccgcgcttggcggcaatgaatgccgcctccatgccagcgggaccggcgcccacaacgagcacgttcttggcctcggcggtaggctcgtaaccggcctcgtcgcgctcgacatcggggttaacggtgcaggagatgcgcttgccaaacatgatgccgttcaggcagcgcaggcagccgatgcaggggcgaatctcgtcggcgttgccggcagccgccttgttgcagaactcggcatcgcacaggttggcgcgacccatcatgcagatgtcggcggcaccgtcctcgatcagctcctcggcaatccatgcctcgttaatgcggccgaccgtggcgacgggaatgttcacgtgctttttgatctcacgcgagcaggcggcgtgcgaggcctgctgggtaccggcggcgggaatcgcggagccgcgcttgatggtggtgccgcccgacacgtggatcatgtcgacgccggccttctccaagcgacgcgagacgtagatcatgtcgttgagggtcaggccgccgtcggtgtactcgtcgcccgagatgcggacgtcgatgatgaagtccttgccgcagcgctcgcgaatctcggcgatgacctcgagcaggaaacgcatgcgagcatcgagcgaaccgccgtactcgtcggtacgcttgttgtagagcggggtcaagaagccaccgagcatgccgtgggcgtgggcagcatggacctcgacgccatcgacgccggccttctgcatacccttctccaatccgtcgatggcgtcacgcagtgcgttcnnnnnnnnnngggcgcggtgcctcgcgggcataggacgggcccacgaaggacggggcgatcaggcgcggcgtgcccgggatattaaaggccatgtaggcggggtggaagagctgcggcatgatcttgcagccgtactcgtgcacggcggcggcgagcttttcccaaccgggaatgaacgtgtcgtcttagcagcacatgtcgcccggcaggtaggtataggtgggctcgaccgtcacgacctcggtaatgatgaggcccacgccgcccttggcgcgagcgcggtagtggtcgaccaggtcgtcggtcacatagccatggtcggccaggttagtggataccggcggcataaagacacggttcttaacctcggtcgtaccaaccttgatggggctaaagagcatcggataggcggaggactccatgcaggcttcctttcgtttgggccgcgcaaggcgctcggtacgctcgagcgcggcatgattgaataggttgatatgacgcaaaacagcgcccatacgggcaaactctatgtggtcggcacgcccatcggcaacctaggcgacctgtcctcgcgcgttggcgaggcttttgccgccgccgatgccatttgctgcgaagacacgcgtgtgacgtcaaagctgctgatgcacctgggtatttccaagccgcttgtccgttgcgacgagaatgtgatcgctagccgcgctgccggcctggtcgaccgtctgctggcgggggagaccctcgcctttgcctcggacgccggcatgccgagcgtgtccgatcccggccaggcgctggtcgaggcggcgcgtgaggccgatgtgcctgtcgaagttattcccggaccctctgcttgcgtcacggcactcgtttcgtccggcattccctgcgagcattttttcttcgagggctttttgggccgaaagcacggcgaccgtgtgcgccgtttgcagcgccttgccgtggtgcccggcgcactcatcttctacgagtctccacatcgcatcgtggcgacgctcgaggccgtggcggaggtctttccccagcgtgagcttgccgtctgccgcgaactcaccaagctgcacgaggaggtcttgcgcgggcccgctgaccagcttgccgaggagctgcgtgctcgcggcgaggtaaagggcgagattgcgctggtcatcgcgccgccgagcgaggacgaggaggccggcatcgcgccggttggcgctgcggtagcggatcccgacgatgccctgcgcgaggatatccgcaccgcgctcgaggagggggagcccgcctctgcggtggccaagcgcctgtctcagaagtattcgcgccgcaagcgcgatgtctatgccatggtgctcgatatgcaatagatggaggatatccagcccttgcgctagaatcatcccctgtatgcaacgtttttctggaggacaaaccccatggatcaaagcaagccttcgttctttatcacgacgcccatctactacgtcaacgccgatccgcacctgggcacggcttattccaccatcatcgccgacgttcaggctcgctatcgccgctccgccggctataacgtcaagttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgaggccgcagccaagcatggcatgacgccgcaggagtggaccgacagccaggctccgcacttcaaggagctttggagcaagctcgagatctccaacgacgacttcatccgcaccaccgagccgcgccagcatcatgccgtgcagtacctgtgggagcgcatgaaggagtccggctatctgtataagggcagctacgacggttggtattgcgtgcctgacgagacctacttcaccgatacgcaggtccagaagggcgacgaggagtacggcagcgtcggccagcatctatgccccgactgccaccgtccgcttgagcgcgtccaggaggagtcctacttctttaagctttccgccttccaggacaagcttctcaagctctatgacgagcaccccgactttgtcgagcctgcgttccgcatgaacgaggttcgcagctttgtcggttccatcaaaaggagtatctcgaatatgagcccggctcgctcatgaacgggctgcggcgtcttacggagcacgccgacaccttcgtggtcacatgcaacatcgacgggcacttcgcgcgcgccgggttcgacgagaaccgcgtgctcgagacggaggggggcatacgcacgtcgatcgacgagcggcgcctcgcccatccagacgccctcgccacggcccagctcgaggagctcgagcgccttgtgcaagcccatcgcaacggcagggtcgccatcctcgaacttggcgtgggactgcgcaacggcatcataaagcacatgctcgcccagatcgcgaacgtctgcgagcacgccannnnnnnnnnnnnnnnnnnnnnnnnnnnagcacgccacctacatcgtgttcaactacagccaggctatggcgcccgatgcatcgtgcgagacgattctcgttgacggcgatatggccccggctttcgaggagattgcccaatgccgtctctagagagggaagcgtataggcttcgaagccttatcgacgatgccgacgccatcatcgtcggcatcggctcgggcatgtcaagcgccgccgggttcaaccattacaaccgcgcaggcatggcgcgcgccggaatgacggactggcagcaagcctttggcttcaagagccttttcgacggcttctaccacctctaccccagcctcgagcagcgatgggcatactatgcgcgatacatcgacttcatgctgcgcgagccgacctcgcagccctatctcgacctacggtccctcatcggccataaggactacttcatcctgagcaccaatgtggacacccaagtcgagaagacgtttcccaccgagaggatctgcaactatcagggaagcttcgcgcaccttcagtgcaagcagccatgctgcgacgagctcttcgacgcgagcccctacgtcgagcgcatgctcgcgggcatggcggggttcgaggtcctcagcgaggatgtcccccgatgcccgcactgcggctggcagcttgtgccgtgggtgcgcgacgacacgtttctgcagggtgcggcctggcgcgagagcctcggacgatacgagcgcttcgtgcgcgagcgcagcgatcgccgcgtgctgttgctggagctcggcgtgggcgagatgacccccggcatcatcacgctcccgttctggagcatgaccgcgaagctgccggatgcgcacctgttgagcgtcaacatctcgaacggctcggctccgctgcagcttggaagcaaggcaggggcgatccaggcagatttgggcgcgctgctctcggcggcgcgggcaggtggcgagtaacgcggagcggtagacgcgcaatgaggttttagccgcagcctccgaacgagagggctcggaggctggtattcctgaatcgcaggtcacgatgggttatcggaatcgcgaagagcggataccgccagtaagcccccttcgggataggcgttgagcagctcctgggcatgggcgaactcggggcctcgtctccagccgagcaggcggttgacggccagatcgccctggacgttgtggacgaagagcaggaaggcgtcttcgcgtgaaagccctgttttctccatgacccagggaaccatctgctccgctccgcgttctatgacgcgctgggctacgcgagcgtatgagtcgctgtccgaataaagcaggcgataatctgcttggttatgtctcgccccgctctctgtggggccattggctactctgcatggttgccgcctccccgcttgatcaggagcgcgaccacgaggagtgcggctccggcgaccgctgcggcggccacggcgtacattgccatatcgccagtcgagggcataaagcctccggtgatagtgctagggggcgtgccggtaggcgtgttgatgagcgacgcctccaggctgcccgtcgacccgtccgcgttgtcggcgcgcaggggcgactcggccgtgatggtgagcttgggcttggcggcggccacctggtcgacgtccaggccctcggccttgaccgtcacggagcgcgtgccctcaaaggcggtgtagcccttgggcgccttgagctcgcggacctccagcttgcccgagtccacgcccgagacggtcacgcggccgtcctcgcccgtggtgacggtggccttgccctccgcatcccacgtgccattggccgccagcgtgcgaccgcggtcgtcggtgatgctcaggaccgccccgggcagcggcctgtcgccgtcgctgccgcgcttggtgagcgcgagatcccaggtgtaggccgtcgcgtcatcgctcggcgtgcgggtgaagccggcgtcgccggactggtcggcaaagggagagcgtgggtagcgcaggtagacctcgttggggttgcccttggcgatgccatgattgcagccgctggcgagtggcgcgttgtacacggcgaccacgcgggcgcccgcggtgaaggcgtcggccccgccgagcgcggcgatcaggtcgccggtgcgcacggtgaaggtcttgccgtcggccgctaccttggtggcgcactgggccgtgatgtcggtccagcccttcgcgggctcggtgccggcgcggccgtccttgccggccgagacggcgtcgaagccgccgcccgcgcccgccgccacgtacacgcgcatgctcgcggccaccttggaggggtcgagccccgcgcccatggtgtcgacgaaccgcaccgcataggtgtcgtaggcggcaaggcccgccgggaccgtggccgagaggcgccagtacaggtcgtcggcgaccgtggcgtctgcggccttgccccaggcggccgtgctgtcctccagcacgtgctttgtcaccttgggcgtcgccgccttgggcttgacggcgacggcgctgccgccgaccagggccatgatcggcgcggtgccggcctcgccctgggcgatggcgtcgtcgtcggcgacgatgagccagtagccgcagggcagctcggccgccgtgcccgcgttaagggccacggacgcggcgccagagctctggagggaacgagcgagctgtgcgctcagcgcgctcgtaaggtgggaatcggcgttgagccactcggcagcttcctgcgcggtgatctgggagtggggcatgccggcgctgtgcagcacgggcaggacagcgtcgcgcgcggcgtcgcttgcccaggcgatctgggagtagaccttggcgtcgttgtcgccgtcggagacatcggcgccaaagatctggtaggcgtcgtagctactcgctacggtgtcgctcaccgtgatggaaccggtcgaggtcggcgcggcctgcgcggaagcggggaacacaaccgcgcaggtgctgaccaagagggcgagcagcgcaaacaagatcgggaaggagctaaatttaacctgttgctgggcaacgacgaagcgggccgcaagcgccatatctccgagcacggcaaggaatatctggaccagctggacctgcagtagcagcaaatcgataacgacggcccttaagaagttcaagaggatatcgtggcaaagaagaagacgaagaaccagccgaagaaaaagcaggtcaacgccgagaacgtcatcggcctgcactccgaggtcaccgaccagccgatcacgcagacgctcgaggtcaactacatgccctacgccatgagcgtcaacgtctcgcgtgcgttccccgagatcgacggctttaagccctcgcaccgcaagctgctctacaccatgtacaagatgggtctgctcaagggcgagcgccagaagagcgccaacatcgtgggccagaccatgaagctcaacccgcacggcgatgccgcgatctacgagacgatggtgcgcctggcaaccggcaacgaggcgttgctcgcaccgttcgttgagtcgaagggcaactttggcaagtactattcgggcgacctgagctacgccgcctcgcgttataccgaagccaagctctcccccatcagcgccgagatcttcaaagacatcgacaaggacccggtcgacttcgtcgacagctacgacggtgccatgaaggagccgcgcctgctgcccaccacgttccccaacatcctcgtctcggccaacaagggcatcggcgtcgccatggcgtctgacatctgcggctttaacctcaacgaggtctgcaccgccaccatgcactacctgcaggatcccgactgcgacctgctcgagtacatgcccatgcccgatttctccaccggcggcgagatcatctaccgccgcgaggagatggaaaagattatcgagaccggccttggcagcttccaaatccgctcccgctggcgctggattcccgaagagcgcatcatcgaggtctacgagatcccctacaccaccaagaccgatgtcatcatcgaacgcatcgtcaagctctccaaggagggcaaggtcaaggagatcgccgacatccgcgacgagaccgacctttcgggtctgcgcatcgccatcgaccttaagcgcggcgtcgaccccgacaagctcatggccaagctctatcgctcgaccacgctgcaggattcgttctcgtgcaacttcaacgtgctcgtcgacggctatccccgtgttatgggcgtgcgccagattctgcacgagtgggtcaagtggcgtattgcgtccacgcgtcgccgcattaactttgacctgggcaaaaagtccgagcgcctgcacctgctgcacggccttgaggcaattctgctcgacatcgacaaggccatcgccatcatccgcggcactaagctcgaggcagaggttgtacccaaccttatgaagggtttcgacatcgacgagacccaggccgagtttgtcgccgagcttaagctccgcaacatcaacgaggagtacatcctcaaccgcaccaaggacatcgccaagctcgagggcgagattgccgagcttgaggagatcctctccagcgaggagaacatcaagaaggtcatcagcgacgagctagcagcggtcaacaagaagtacgtgatgccgcgccgcacgggcaggatcgagccccatgaggttatcgaggtaagcttggagcccgaggtcgaggagtacccggtcaccttcgccataggaaccagtccgagcagcggcggcacctacgggtacacgggctccacgcagttcatcgggtgcatcaccaacaacggcaacaactggacgtggggcaccatcaacgtggtgaacggaatcatcaccggcatgagcagcatcacgggaaactagaccagcgagagaggaaacggaatgttctaccaccttgtgcagcagcccgaagcgccgcaggcgctcgacggcgcgccgaagccgcccgaggcgcttccggtgttcgagtgcatcagcgacccggccacggcgcgggccatcgtggaatcggaannnnnnnnnnnnnnnnnnnnnnnnnnnnnttcgacggcaagggcggcttcacgctcgtgtccagccccgtggccgtcatggacgcggaaggcggcgaggccaacgccgtggacttctcggcgctcaccgacgaggagatatgcggggtccacagagcgcagcccggcgacatatcgcggacacttgcggccgaaggaaaggaatgaggcatggcaacgcacgagcttacgctcaacctcaagaagaccaacatagcgccgcccgtcatcaccgtgcaccagggcgacagcgccgaggtcctgaaggccgccatctacgacggcgacaagaaggcggccctgacgggctgcaaggtgcacctcatggctgcgaagcccgaccacacctacgtggagcagcagttcacgggcatcagcgacaacgtggccaccgtgaccgtcaaccccgccgtcttcggcgtggccgggctgctcaaggtgtgctacgtgcgcgtgcggaacgcggcagggctggacgccaccaccgagaacgtcctggtgaacgtgctgccctcggcgagcgcgtcgggcgagatatccggcccgtacgtcgatgcggtggaggcgatcatcgcgaacctcgaagggcagctagccgacgtgagcgcgctgaacgcgcagatgcagaaggccgaggcctcccgcgcgagcgcggaaaaccagcgcgccacgaacgagaaggcacgccagaccgccgaaaccaggcgcgcagaggccgagaagaagcgagccacggcggaaagcgaccgcgtgaccgaggcgtcgcagctgaagacggcctcgcaagccgccacggctgcggcaaacggcgcggcctcgaacgccggcgcggcggcaaacatcgccctgcagatagccaacagcgtggcgcagggcagcgcgggcagctcggacatggccaagcagaagcagcagatagccgacctgtacggcaagctggccgacgccacggacgcgttcatctacgacgacggcaccgtgtactgccccgcctccaaggccagtgcatctggcagcaccatcacgttcgggagcacctgcacggcgtccggcacaaccctcaacctcaagtagaaaggcaacgaaatggcacaagcgaaaaccctgtcagtgggcggcatcggctacgaggtcatcgacgataccgcgcgcagcaacgcgcagacggcgctcaacaacgccgagtacaaccgccagggccaaatcggcaagtacggcgggcagaacatcgccaccatcctggcgggagagatcggcagcggcagcgtgtacgacgcgctgcataagcgcatcgccgccgcgaacttcggggaatcgacgccgagagtgctctgcgcgccagcacggcaaagttccgccgccgctgggccgcgatggagcagatgacggccaacgcccatatggatctggctgagctttcgacccatggcctcaacgacctgtgggatgccgcaaaggcggaggagtaaaactgcgggaacgacgagctgacacgtctcatcgttcccgctaaatttttcgaaaacaattgtatccctcggttaacttagggcataatgcaaaagtgcgacatggctaacttacggaggcgcaccgatggtgcacggtcggccagtcgcttgcatcaactacgtttccaagtgagagggagacagcatgagtgacattttggacgtctacggtcgcgaggtgctcgacagccgcggcaatcccaccgtcgaggtcgaggtcgtgctcgaggacggcagcttcggccgcgcgatggtgccttcgggnnnnnnnnnnnnnnnnnnnnnnnnnnnnnnnnnnnnnnncgacaagggccgctatctgggcaagggcgtctcgcaggccgtcgagcacgtcaacaacgagtgcgccgacgccgtcgtgggcctcgacgccttcgatcagcgcgccgtcgatgccgcgctgatcgccgcggacggtacccccaacaagaccaagctcggcgccaacgccatcctgggcgtgtcgctggccgtcgcccgcgccgctgccgagtcggcgggcctgtcgctgtaccagtacctgggcggtgtcaacgcccacctgctgcccacgcctatgatgaacatcctcaacggcggcgtgcatgccgacaacaacgtggacttccaggagttcatgattatgccggtgggcgccccgagctttgccgagggcctgcgctggtgcgccgaggtctaccacaccctcaagggcgtgctgcacgaggccggcctgggcggcggcgtgggcgacgagggcggcttcgcgcccaacctcaagaccaatgccgagccgttcgagtacatcaccaaggccgtggagaaggccggctttaagcccggcgtcgacttcatgtacgccatggacccggcctcgaccgagttctacaacgccgagaccggcatgtacgagctcaagggcgagggcgttgagtacacgagcacccaaatggtcgattactgggagaagctcgtcgacacctatcccatcatctccatcgaggacggcatggccgaggaggactgggacggttgggtcgagcttacccgccgcattggcaacaaggtgcagctggtgggcgacgacctgttcgtcaccaacaccgagcgcctcaagaagggcatcgagctgggcgccgccaacgcgatcctggtcaaggtcaaccagatcggtacgctcaccgagtcgctcgaggccatcgagaccgccaaggaggccggctacgcctgcatcgtgagccaccgctccggcgagaccgaggattccacgatcgccgacctggtcgtgggcgtcaacgccggccagatcaagtcgggtgccccgtgccgcagcgaccgcatcgccaagtacaaccagctcatccgtatcgaggacgagctcgagggcagcgcgcgctacgccggcaaggccgcgttctacaacattcgctaaggcaagtggtgctcgcggggcgttgcatgatcagccacgtgatcagtgcacgatctgtcacatgattagtgtatgatcacccagcgctggatgatgttggcaagtccctccgtatcgcagaaggggcacgcggtgcccgggcggcggttgtcgtcgggcttgccgctcgcctgctggacatcaaatacgagcgccacgggctacgcctccagcggcacgattctggtgccatggagctcggacacgcccagcgccgccgcgaccgcatcgcggttggccgcggtgatgccaccaccgggaaggatggtcaagcgatcacccgcatactcgatcaagcgagccagatgatcgaaattaccctcaatcggcgtgccggccgctccgccgtgcgtcaagatgcgcgtaacgccgcagtcggcaagcgtgtcaattgcatcgagctgagcctcgggtgagagctggtcaaatgccatgtggaaggtgatgtcgatgagctcacgcttgcactcctctgccgcacagcccgcagccatcacgagggcgccgagggtgagctcgtcgagcgcccagccgccggcacagggcttgcagcatccaaagaccaggccgtcaacgccggcactcacggcaaggcccagatccatctccatcatgcgcagctcgtcctggctgtaatgaaagtcgccaccacgcgggcgaatcatgcacatcacctgcgcatcatgctcgtgagcattgttgaccgtagcgctgataacgccgnnnnnnnnnnnnnnnnnnnnnnnnnnnnngaacgataatcggcccaggttgtcgcacagctcaatgcgccccgcaccggcctcgatagccgccggcacccgctcaaagttctcggcacaaaactcgtacagcatagatagacccccaaaggcagcaagtgttttccgacgggcattgtcgcacgcccccatgaagttgcggtggaatagggactgttttggcttcttgaacccccaattagtccctatttcaccgcaacttaaaaagggggcgctgaccgggatagtcagcgccccctttgttgaatggattaaccgcccagataggccttgcggacgttgtcgtcatgcaggagctcctggccggtgccggtcatggtgatcttgccggtctcgagcacgtagcnnnnnnnnnnnnnnnnnnnnnnnnnnnnnnnnnnnnnnnnnnnnnnnnnnnnnnnnnnnnnnnnnnnnnnggaagatctgctcgatcagaatcggcgccaggcccatggagggctcgtcgagcatgagcagcttggggttgctcataagggcgcggcccataacgagcatctgctgctcgccgcccgaaagggtgccggcgacctgacgacggcgctccttaaggcgcgggaactgctcgtagacgcgctcaagacccggggctaccgtggacttgggctgcgtgtaagcgcccatctccaggttctcctcgaccgtcatctgcaaaaaggcgcgacgtccctcgggaacctgagccagacccttgcccaccagcttgtcggcgggcgtatgggtaatgtcctcgcccataaacttgatggagccggtcttggagcgcagcaggcccgagacagtcttaagcgtcgtggacaaagcccatgacgcggcgcatgatgggcgccgaatcgggcagggtgaagcggcggagctgcgaggtgggcacgtaggcttcctcgcggcgggcgctgcggcgcatcatggcggccaggcggtcattgggctccgatgcggcctcggtggcctcgggcgcgggcgcgacggtctcggcggcagcagcctgctcggcggccggcgtctcctgctcgcttgcaggctcggtcgcgggctccggatcgccaaacggcaacgagggctgcaccacgccgcccggaagcttggcctccggcttaggctcgcccagcaacttgccgcgacggcgacgagccggcttctcggcctcacgcgcggcctcggcagccgcctcgcgcgccttctcggcaacaaacgccgctgccgaggtatcgagctgcaccgttgcgtgcgtgcgggtgggcacggcgacctcgccggcatgcatcacaatgactccgcaggtgctcgtcttaacaaactcgaccatcttggggtcggtgaagccggtcacgtcgttgacgatcgaggcgccgcagcgcacggccgccttagcaaccgccacgtggcgcgtgtcgatcgagacgatggcgccctctttggccagcgcgcgcaccacgggcagcacgcggcgagcctcctcatcgggattgaccggggtaaatccggggcgcgtggactcgccgcccacgtcgatgatgtcggcgccggcgtcgagcatcgccaggccgtactcgatggcggcatccgggtcgaagtgctccccgccgtcgctaaacgaatcgggcgtcacgttgaggacgcccatgatgcgcggacggtcaaagctgagctcgtactttccgcaccgccatgtcttgctgtcgttcgccatgaacatcctcctaaaatgcccacgccgccgcgctcgggcgctggcggcgtggtcgctttgcaatcagtctttctattgtatccgcgcacgcgggctagaacgcaaacgcggccgcgatgtcgcaagaaatcagcaggtcggcatttgcatcctgatcggtaggcgccaaattgcaaatggccagcgtatcgccggtaaagtaacgcgtaaggcccgccgccggatacaccacgagcgaggtcccacccacaatgagggcatcggccgcggcgatggcggcaacggcaccggtcaacacatgctcgtcgagcggctcttcgtagagcaccacatcgggcttgatgcgaccaccgcacgcagggcacacgggcacgcccgcggcgtcctcatgctcgcgcgagcaaatccactcggcgctatagaccgcgccgcacgactggcaaatgttgcgatggaccgatccgtgcagctcgaacacgcgctgcgagcccgccatctgatgcaagccgtcgatgttttgcgtcaccacggcatcaagcttgccggcgcgctccagctcggccagcttggtgtgacagcggttgggcttagcgttaagcgcgatcatcttggtgcggtagaagtcgaagaactcggccggatgcgcctcgtaaaagctatgcgacagcatggtctcgggcggataggcaaactgctggtgatattgaacaggtggccgaagccctgctggttgtcctcggcgtcgatgaccttgccgtgcgcgaaattccagcgcagcaccacggcgtccttgtggacgatgaggaagttcatgtccaccgcgccggtgcccttcttgtagtggccgatctcctcgtccttggtggtgccgtccaaaaggtcgatggcgctgtagaagcgggactgcggcaccttcacgatggaggagaagccgtccagcgcctctcgggacttggtggtgtccaggtccttcaccatacccagcagggtgggggtgatgaacagcacgcggccctcttccggcacctccttctcgtccatgtcgcacatggcggcgttcaggcccttgagcatgtccgcgccgtcggagtaggtcttctgctccttggtgatgccggtgcctgcgcacagcgtggagaacacgaacgcgtctccctcgggcaccaccttggtgcggttgaagtgcgcggcggcgttgccgaacgccagattgaaggactgggcgtccactttctggtcgatttccaggatggtgccgcggtcgtagttggcgctgatgggcttccaagtcagggacgcgccgctgttctgcggcagtcgcccgttggcctgcacgtcgcccaggccacccatggagtagacggggtagtagaactcgcccagctgctccatctgcgcgatgttgccctgcggcgctctcaagcactgcggtcagggattccttgcggtacgcctccatgagcacgttctcgtagcccttgggcagttcgatgctgtttggcatgatttactcctttgaagattcgtcggtgagtccgaaagctgcgcggaagtcggccaggccgtcggagcctgcgccgcccttggggtcgccgcccgcgctctcgcggggctggtcggtgaacatgtaggcgttatccttcttcagggcctcgaagtcgatgcccgtgaggttgccctgctcgtccagcttcgcgtcagcgatgttcgggatgatcgcgcgcgccgccttggcgttgcgcacccccatctgcgccagcttggtgtcgatggcgaagtcgcggcgcatgtcggcctcgcgcttctcggcgtcggccttgtacgcctcgttgtcggccttggccttgtcgagcgcggcctgcagttcgtcggcgttgcccgccttggcggtgaactcctcgatctgcttgtcgcgctgctccagctcggccttgagggccttcacctgctcctggtactcgtcggtctcgcgcttgtacttcgcgtaggacacgacctccttcgcgggctcggtctgctggccgttgtcgccgccctcgttgccctggggcttgttgtcgtccgccatcgcttgctccttccgtgtttggttgtcgcgcttccctgcgcgcttggatggcccgccgttgtcgccgcggtcgcgtgcggggcatgttgtcgccgccccatcgcgtgacctcatcttccccgaggtgtcgccaggcaaaagaaaaggccgcccgtgatgggcggccttgatgccgtgcgtctactcggttgtcgcttggtctacttcatcagccccgcgtcgcgcagggctcatcgtcgagcgtcacctggtaggtagccaggttgatctcgaggttatcgatgttgagcacgtcatcggcggtgacggtctcctcctcgcccatcaggcgctgcgcacgagccttgagctcgttgggcgtcgccgtggggcatacgaagtcggcatgcgcgtgattcggcaggcgcagggtgccgagcgcctcgtcgtcgacaatcaccagcatgggaacgccgccgcgatcgtcgagccacttggcaatctgatcgatacggtcgctgcggatgccgtcggaatcgaggatcagcaggtcaaagtcgtgcgccgcagtcggcgaatcgggggtggcaaggctcacctcgacacccagggtggtcgtcaggctgcgggcaaactcgtggaagcgcgtcgtgcgcgccatgaacagggcactcttttcggacatatcggcctccaaggaaatgagctcaatcgtactggaacaagtcagcgcgattaggagttcgccaggtagtgcttgatctcccattcggtgatcgtagactcaaacttatgccactcgtcgcgcttctttttgaggaagaagctgtggatgtgctcgccgagggcatccttcataaactgcgagtcctcaaacacgtcgagcgcctctttgagcgagcgcggcagcggcgtgtagccggcctcgaccatctgacggtcggtaagcttgagcgtctcggccgtggcctcgggcgggagctccagcttgcgctcaatgccgtccagaccagccgccagcgtgacggcgttgacnnnnnnnnnnttagccatgggatcgggactgcgcagctcgatgcgcgtggacagctgcttgccgggcttgtagaccgggatgcggaccatgctcgcgcggttgcgcaggccccacgtggcgtactgcggcacggagtcgccaccggtggtgatgcgcttgtacgagttgacggtggggttggtgatggcgctgatctcgcgcgcgtgcgccaggatgccggccatgtagtgtttggcgacgtcggagagatggtacttatcgtcgtcctcgccccaaaagacgttgttgccgtcgtggtcgaacagcgattggtgcaggaacatggcgctgccgtcctcgcccgccagcggcttgggcataaaggaggcgtggcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggccggcggcgtggaaggtgtactccacgggcacggacatcttctcgagcgtaaggaccgtgttgcggcgcaggtcgcgggcggcgtcgctcaccgaaaggtcaaagtagccaacgttgtcgagcggctcgggcgtgcgctcgtcggggaagtagtaatactccagctcggcgcccacgttgagcaggtagccggccttctcggccttgtggaacatgcggcgcagggcatcgcgcgggtcgccggcgaaaggcttgcgatcgggagtgcacacgtcgcagaacacgcgggcggcagatggtgtcgatgttcctgatcggcatgggcatctcggcgctcaacgccaacctcatcaaggtgctcggcacgtggttccgcgagcagaccggctttgccatgggcttgttctacgccgcttcgtgcgtcgccatcgtcgtcgcccagatctgtgccggcatgttcggcagcgttttcaactcctacatggttgccgctgtcgccatgaccatctcctgggtcctttggatcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagctcggcaagggcatcgatgccgctaccgccggcttcatggccgccatcgtcaccgtcggcagcttcttcggctgcatcgtgggacctgctttctgcgacaagcttggcaagttcaagggcttcctcatcgtcaccacgctcatcggcgctgtctcgatgttcgtgacgtggtacacccccgtcggcttcctgctgtgggcgatcctggtcaccaacggcttcttcaccgccatcaacggtccgatcatgcagtccatgccggttctgctccccgagatcggcgacacgtacgccggttccgctggcggcatcgttggcaccatctccctgctcatgagctannnnnnnnnncttcctgcccatcggcatctccgctgtcgccggcgccgactacaccatgaacatgggcctcgagagcctctgcttcctgctttccgtggtgccggtcttcttcctgcccgagctcggccgcaaggctatgcaggctgccgccgctaaggacggcgagtaatcatggaggcggtggttcctgccgacatcgtcattaagacgacggcgctgtttacggccgaggagcttgagccccatgcgggatgcgtcgcggttcgcggcaacgagatcgtcgccgtgggcgcacccgacaaggtgcagccgtttgtcggtcccgataccgaggtgatcgatgcgggcaacaagctggtcatgcccggattcaacgattcgcacatgcactttgcgctcggctccatccagaaagacgaggacttctgctgcgatttgatgttcttgccgagcgagcaggcctgcgtcgatgccgtggcgaagtttgccgccgagcaccccgacaacccgtggatctacggccagggctggtattcgcccgcatgggaggatccgactgatcccgactgccgtagcctcgatgcactcgacatcgatcgcccgattgtgctttcggacttttcgatgcacgtggtttggtgcaataccgccgcgctcaaagcggtcggcatcgaccgtaacaccccgacgcccgagggcggcctcatccgccactttgacaacggcgagcccaacggttttctgtccgagccccaggcgacgaacattctgctcgatgtggtgctcaacaagccggacctcgatgcttcgctgctcaagtcgatgcgcaagtttaactcccagatgaagttccagggtatgagcagcgtctcgatggccaggttcagaatctcgcccagcagcatcacggcgacctgcaccacgttgcagatgccgtcccagatggacgaggcggtgccggccaggccttggaagaacccggctatggcgtcgatggccccctgcaccgtggagcagatgccgtcccacacgccgcccagcgtctcgccgagctgcgagaataactcgccgacgctttgggccacgtcgcccgccacctgggtggccacctcgaacgcggcgcacacggcatcccacacggcggtcaccgcgtcgcggaactcctcgcaccacggcggcgatgatggccgctatggccgctaccacgggatgcgcggctatgagccccagcgcgccggtgcccagcttgccgaccacctggaaggccgctccgattttcggcacggtgtccacgacggtgccgaccgtcgacagcacggggcctatggcggccgctatcgtggcgatcgccagcacggcggtctggccgccctcgccgatgccggcgaaccactcggagaacgacttgacgacacccgccacgttggtggcgatgttgagcaatggctcgccaagcggctcgatggagccctgcagctcgcgcatggcctcctgcgatttcacggcgaagctgtcggagacggcctcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtcgtactcgtttggcatctgcgtgaggtcgcccagcaccgcctgcagcatgtccttggcggtggcgctgccgttcttgaagttctcgaagacctcctgcgtgccctcgctgaacgagccgatggattcctccatgcggccgtcggacagcgccgtcaggaactcgttgaggtagtcgcccaccttgtccaggttgtacgcgccgttggacgtgcccgcttcgagcagcgagaagtactcgctggcgctcattcccgcctcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaggccgcgctgcatgcccgccgtcagcaggtcgctggcctcggtggcggacagcccgaagccctccatgagggcgttggtgccgcgtatggactcgttcacgtctgcgccgaaggtgtccgacagcatgagtgcgttggtggtgacggtctgcaggtcctcgtcggacacgtcgcgaagggtggacttgcactggatcagcgcatcgttgacctcgtccagggactggccccagccaccctcgtatatgcgcttgcctatgccgctgaaacgctcggcctcctcgccggacacgccgaacgcggcggctatgcgggcgttggcctgctcgtagtcgctggtgtacaaggagggcctggaccttctcgtcgtgccctccgccgagctctcccgcggccgcggcggcccgcgctgcatgagcatgcccttctggcgcgaggacctctaaggtcttcaaggacccgtacaggtcataatacatacatctagctgccattagatgtctcccattggggcggtgcgggttttcgcaccgccccaatcttgtatgaggaacgtcaacacgattggacgactgcttttgtaaggagcttggccatggacatcaagacgattggcgttgaggaatggctcaacgtttgggagaagagcgccacgtgggacatcgcccagtcgacgatctcgtcgctcaccatgggcgagctgcgcgcgctcgatgaacaggacggcgccacgttctacgagcgcctggaccgcgagaagatgaactacggctggatcgagggctcgccggaatttaaggccgaggttgccaagctgtatcgtcgcgaggtcaatcccgatcacattctgcagaccaatggctgcacgggcgcaaacctcaacgccatcatggctgtggtcgagcccggcgaccacgttatcgccgagtggcccacctacgcgccgctctacgagattccgcgcacgctgggcgccgaggtcgagtattgggagcttcgcgaggaactcggctggaagcccgatatcgaggaactcaagcgcttggtgcgccccaccaccaagctcatctgcatcaacaacgcatcgaaccccatcggtacggttctcgatgccgatatgctcggccagattgccgagattgcccgctcggtgagcgcctatgtgctgtgcgacgaggtgtacctgccgcttgagaacaccgaggcctttatgtcgatggccgacgtgtacgagagggccattgtcaccaactcgttgtcgaagacctattcgacgcctgcggcccgcgtgggctgggtcctggccgacgaagaggtgtccaatcgcatgcgtacctatcgcgattacaccatgatctgcggcggcgtgttcaacgatgccctggcgacctatgtgcttgagcacaaggataagattctcgagcgcaatcgcaagatcgtgtttggcaaccgcgatatcgcgcaggcttggatcgatacgcagcatcgcgtttcctggacggccccgcagggcgtgtccacctcgtttatccagctggatattcccgaggatgacgaggagttctgcaggcgcctgctgtccgagaggggagtgctgctggtccccggtggccgttttgagcttccctgcggcgcacgcctgggctactgcgcgagcgaggacgttctgcgcgagggcctgaggcttttgggcgaggcactggcggagttcgatcgctaggattccgatggtcttcgggggccttatccaaattagccgaagataatcgaaaacggacccgtttcataggggaagcgggtccgtttttctataccgagaagtcaagttgttacaaatggggccgtaaagcgagccggtatccgctgggccttatactgatcggctagcaccccaccccacaggcgtttgagcgggctgcggcgacagagcagcaggcgcgcgtcctcgccctggtcctcgaccagaagcgtcaggaatgcttgatgcagaatgccctcgccggtatgggctttgatgcgatcgacaggagtgagcacctcgccggtcgcggcatcgaccgccacgacctcggcgcccgcaccgccctcgtcccagccggcacgcaatatgcgggctgcggtttcttcgagcgcggcgatgagctccttggtggtgttgagcacgcgctgcagatcgtccttgctcgcctgctcaacatgaaaacccgtgcttgcggtcaccggcacgccaaaacgcgtggccagtgccgctgcaatgtcgtgcgccgggatctcgtcgcgatggcacggaacggccaagatgctcatggtcgccgtgcgtccgggctcgggtcgcggaatggcctgcgccgtggcgcccagatgtgcaaactcgggcgagcaggcgtacaccaccatgcctcgcggcgtcaccgtcaactgagcctcgagcgtaaacttgccctcgcccactgcaacctttgtcgtgtgcattcccatgggatctcctgtcgcccgcgatgtacctgagaccatcttcgcctgtattgcgactatacaggcaagcgcagaatgtgacaaaggcgctgcttcttgtcgtattctgctagagttgcagagactgaatccagctcatataacgcaactatgggagcaaccgccttgaccactgcaacctcgtccacaacagcatcaaccgctgccgcgctttcacccgcgcgcaccaacctttgcctggcgctgctcgtgctgttgggattctcgctcggctgctccgagttcgtggtcatcggcatcgaaagcgatttggcaacggaactcggcatctcgcttgccaccgcgggccagctcatcagcgtgttcgcgctcgtctacgctatcgccacgccggtacttgcgctcagcacggggcgattccgccgctaccagctgctcgtgtgctacagcatcgtctttgtgctcggcaatctggtcatggcgttggcgcccaacttccaggtgctgttcgcctcgcgcatcatcttgggctccgtctcgggcgcactgctcgccgtgggcgtgacgtatatccccgagctgctgtccccgcagcagacctcactcgctatctcggtggtgtacggcgcattctccgtggcgatggtctttgtgacctcgatcggcaagtttgtggccgacacgctcaactggcacgttgccatgtacggcacgctgaccttcgccgttctgatctgcgccgcgctcgtgacgtttatgccgcgcgccggacaaaccgacgagcctgccaccttccgcgagcaggcggggcttctgcgcgagccaagcatcatcaccggcatgctcatcttcttgtttggcgtgggctcggtctatgtgttctacggctacgtgacgccctatctggagcaggtgctgggcatgggcaccgttcaggcgagtactgtaaaaccggtgcctcgcccacactggcgccgccggcagcactcaaggatcccttggcaagggaacgtgagtacacaatcagttttcgagcgacgtcatcgtaatccactggggatattgtcctttgcaactctagaagggccataaaaccgtcatttgccgtacattagttaacattcgcaacaatttttttatgataccccaacgcggaagtctattgctcgtccttcttgcgtcgcataagctcctcaacgtcgacaccagcggcctcgagcatgcgctcgacattctttttggcgttggtcgtgccgaccttaagcacgatcgaaagcggagtgcccaccaccaggcacacgatgcccacggggacaccccagccggggccgccctgcataccccacatccccatcaaaaagccaatcgccacgagcgaatagcccaggcgcagccaaacattgagccgctgaatagcatcggtctgcatctttgcctcgcgaatcaagtcgtcgcgcgaaaggtcgtgtccatgtttctcgtgcatatggtcctcctcgtgcaaagtgtgcatcatgcgcaagtgcatcgtttgtcgaatacgtcatctttcaagagcaatatagcgggtgtcgtgtaggcgatggaggtcgctagccatattgcccttgaagggcggcgcaaaatcagaaggccgtgcggttgaggccgcacggccttacagggggccaggggatgatgactagtagctcagtgccgggtcgaagaagccaatgagaacgcccacaaatgcgatcacaacgaggatcagcatcataacgatggggttgaccttcttcttggtcatcatgtaccagcagaagatgatgaagatcatcggcagcaggtgcggatagatgccatcgagcgtgtcctggaacttaccgccaccgggcagcaccaggttggggctgcaggtgatggagacccaggtagcaccgactgcaccgatgaccatggtaccgaccatcacgatggaatcacgcagagccttggccttggggccgacgagggcctcgaccgccttgccgccgagctcatagccctggttgtaggcaaagcgcatgccaaggaacatgagcaggttccacacgacaatatagaagatggcgccgagcggggagccgccggtcgagagaccgagggcaataccgagcaggatcgggatcagggtaccgacgatcagcgagtcgccaaggccggcgagcgggcccatgaggccggcgcggatgccgttgatggcgtcgtcgtcgatggcctcgccgtttgcgcgagcctcctcgaggccggcggtgacgccgacaatcatggtgccgatctgcggctcggtgttgaagaacgcggagtaggtctggagggcctgcttctgctcctcgggcgtgtcgtagagctcctcgacaatcggaagcatggcgcacaggtaaccgaaggtctgcatgtgctcctgcgagaagcaggtcaggttgccataggaccagttacggaacgacttggcaacagatgagctgcgtgtacgcgcgcacgacggcggaggcaaagcagattgagcggcgggtggtggcgggaagtctcgaggtggtcatgccggggttgtatgcgcgtccggaatactggtccgagctcaagtttcggcaacgttatctgcatcgggtgcgggcgcttgcgcaaaagcaccccgactggacgttttgctcctatacggcggctgttatctatggtctttcggtttcgcatgccaatttgacgcacatccatatcgccgcgatgccggcgcaatcgacgacgccgggctctcaggtcattcgccatcgttatgcttatcgaacgcgggccagtcaaatggatattgccatgaccgatatcgatcaaacgattacggattgcctggtcgacgcgtcgtttgtcgagggggctgatcattgcggactcggcgctccatgagcagctgttgtcgaaggagcatctcgttgaggcagtcgacaagctcggcttaaatcgtcgcggtgttgtgacggcgcgcagggttgcacggtatgccgatggcctgtcggaaagcggtggcgagtccaaggcgcgcgccctgatgatcgagcgcggctggcagacgccggagctgcaaattgagctgttcgacccggttgagccgggacggccgtatcgcgtcgactacttgtggcgcgtgggagatcggctgatcatcggggaatttgacggattcgttaaaagcgagaaggcggcggaggagggcaagctcgcaaaggcgcaatttgacgagcgccagcgcgagtcgaggctttcgatgctcgataactgtaagattgtgcgcttgtgctgggatgatctgagggacccgacaaagctcgatcgcaagctcaaagttgccggcgtgccgcgtgcatgttgaggcggttgcggggcgttaagctgcacgagcgtggataatcggacacacgagcgcggaaatctggacgcgcattgattgagcgtggattttcagacatacgagcgtggattttcggacgcttgccgaatgagcgtggaaatctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtagcggtcgtagcaaccgccgccgtagcccagacgtgcgccggcgcggtcgaaggctacgagcggcacgacgatcatgtcgagagcttcggcgggcacgatagggaagcggctgctgtcgatgtccgtggccgcgaaggcctgcgtggggtgggcgataaacggtgtcgtggatgcatcgtcggcggcaactgccctcatgcacatgcgctggccacaagctgtggcatcaattgccgagagcatgcacggataggctacgcgccaccagaacgctcaacccattaggagagttccgcctaaagggtaactacacaggaccccgccggggctgtttgggctacctcccaaaatattccgcaggacgcaagaagccctcgccgcactccacattgggcgcgaagcgcgctttattcccttcagccccaatccctgaagaccgaggacgaaggggcccgacgggtttccctctggatgcatcctcgcacttgaagcccccttatcctgctccttcggagctgcggacaaggcgccacactggtctgcggagtgttctgaaaactaagcccggcccccgccggacaggtccaccgctactcgcagagcagcttagcaatctggacggcgttggttgccgcgcccttacggatttggtcgccgcagcaccagaaggtgatgccgcgcgcggcctcggggttcgagatgtcgcgacgcacgcggccgacccaaatcagatcctggtcggacgtgtccatcggcatggggaagcgatcgtgcgcatcctcggcagccatatcgtcaactagcttgacgccaggagcggcagccagcgcagcgcgggcctcctcgaccgtaatatcgcgctcaaactcaagcgtaatgctctcggagtgcgaacgcagcacgggcacgcgcacgcaggtgcagttcacgcgcagctcgggcaggtgcatgatcttgcggccctcgttctgcagcttcatctcctcggaggtgaagccttcctccttgacgccgccgatctgcggaatcaggttgctcgccagctgggcggcaaaggcgcgcggctcgggaatctcctcgccacggcccagagcggccagctgggcctcgagttcggccatgccgggagcgcctgcgcccgaagccgcctgatacgtcgagacgatcatgcgcttgacgccggccagctggtgcagcggccaggtggggaccaggccgatgatggtcgcgcagttggggttggcaatgaggccgtggtgccacttgatgtcgtcggcgttaatctcgggaacaaccagcggcacctcgggatctaggcggaaggcatggctgttgtcgaccacgacggcgccacgcttgacggcctcgggcagcagctccttggcgatatcatcgccagcagcaccgagcacgatgtcgcagccctcaaaggcctcggggcaagcctcctcaatcacaacctgctcgccgcggaactcgacggtcttgcccgccgagcgtgcgctcgccagcagcttgagcttaccgaccggaaactcctgctcgttcaggcactcgagcatctgggtgcccacggctcccgtcgcgcccaaaatagcaaccgtgtactgtttcatgcttccccctttaaaggttctggcttttgcccgcacgcttagcggactcaatagtgtgccccagtttatacaagaacggggcggacacaaaacccgccccgccgaaacgaaaccgaaacgaaacgccccgcagtagattttcaggcatgtcccagaaatctaccggagtggccaatcggcacattgatggggccgatgcctgcaaacacaccggcatccatgcccacgcaaagggacagtccctttgtcacatcactgcgtcgcacgcttacgccacgccgtcgcgggcgagttcctcggccagtgcctcggcaggcatggccatgatcgcgtcgagctcggtgtcaacctcggaaatgtgcttgaccttcagcttgcgcaccagctcgccgcggcacatcacgtgcatcggctcgcgcagggccgccaggtcatccagaggattctcgcgcgccaccaggatatcggccgccttgccgcactcgatcgtgccggtctcgtcgcccaggcccagcagctcggcattgacctgcgtggccgtgtgcagcgcaaaggcattgctcacgccgacgtacttggcaaagtacgccacctcgcgccacatgtcgtactgcgtcacgaacgggcagctcgagtccgtgcccaggcccaccttaacgccagcttccagtgcggcgcgggcgctctcgacaatgcccgagcacacgatgtcaccgttcttcttttgcgtatcggtcgaatgggtcttctccggatcgagcagtacaaacggcaacgccggactgatcgtgcaggtcacgctcggtgcgcgcccctcgagctgcgtacccgcggcgccgcgatacaggtccaagatctcgggcgtcatcggagcgccatgctcgatcgtgtcgacgccggcctgaagcgcggcctttacgccctcagtgctctcgacatgggccataaccggaaggccaacctcgtgtgccgctttgcacgccgccgcggcgacatcgaccggcatgcgcagcacgccaggctctcccacttcggtcgcatcgaacacgccgcccgtcacgaacaacttgatgacgtcggcaccgcgcgcatacaggtcgcgtacctgctcggctgcctcggcgggactattggctacctgcgcgaacaagcctgcgccatgaccgcccggcaccgtgacgcccgtgcccggcgcgacaagacgcggaccctgatacttgccggcgtcgatggcgttgcgcacggcgatgtcggcaaacagcggatcgcccgcaccgcgtaccgtggtcacgccgcttgccagctgctgctgggcactgcccttgaggatatggcggacgatggcgcggcccacgggattatcgagctttttcatgagcgatcctgcatcgcctgccgagaccggcttgcccgagccgcacagatgcacgtgcatattgatgaggcccggcatgaggtacgcaccggccaggtcgataacctcggcacccgcaggcgcctgcgccacggcactcgggccagtccaggtgatgacaccatgctcaacggccacggccatatcgggctgcggctccatatgctccaagccatccagaatagtcgcattgataaacaacgtgggacgatcggcagtcgccatatcgggctcctccccctcaattaacatgaacatttgttcattatcgaggaaatcacggtgactatccccgagagctacgccggcgccgtgatgggcgacatctcggcatcgcgcggtcgcgtgacgggcatggagaccgatgagcgcggcgacaccgtggtcatcgcccaggcgccgctggccgagttgacggattactcgacgcgcctgcgctctatcacgcgcggcacgggtgactttaccatgaagcccgctggctatgagcaggttccctatgacgttcaggccaagctggtcgagcgctatgaggagggtcgcgccaagtagcgtgcgattttgcctgcaatgtaggtgctgacgaaagggccgccttgggtaacaggggcggccctttttggtccccggtgggttgcaaatcggttcttgtcgtggcttggggctagttccccgaggcctggttgcggccggtgacgtagtcgatctgaacgtgcggctgtaggttatagcagtacacgtggaagcacagggtcttgccgtggtcttcgaccgattgcgcctcaaggcgcacaccgcggcagacaagttcctcttcgttatacatgggcgtgacgcggtagagcacatggttgcccgtgtcgcggatgtagccgagaatctgctcctcaaacggcagcatgcccgtttcgttgagatagcgcgtgccggtgaggagatttttgcggttggcgttttcgccgcagagcgaccaggcgataaggtggcagcggttgtagaggctctggcccggaataaagtcgtagcgctgctggtgccaaccggcaggatggatacgcgagatatcgccgcgctcgccttgaccgagtgattcggggcccacgcaggcgagtgctttgcgggtgcggcccaggctgtcgagcttggagaacttcttaaagcagccctcttctgtagcgcgctcgtattcatcgagcgtgaatgatggtgtgccgagcgggtgggtgctatcggcgcgaagggcaacgtaggggttgccggcgtagtcgggaatgctgctgagataaacaccgcgggcgcggttgaggttggggttttccacctcgtcgatgggggcggtggagctgtcctcggcaacgttatcgttggtgttggtcgcggcggattcagggccatcgccagagtcgtggctattttgagagtccgaggaactcgctgttcccgattcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnngttcatcgctttgcggcgacagcagcttgggagctccgtcgagcgatcccgtaaacagcgcaaaccccagcaccacggcggtgccgatggaaagtacttgcttgtaggtggacttgcgcgacattgaggctcctggatggacggttgggaatctaccagtctagcaggtgccgtcgcgggtcattcgatcgaacaaatacttaagatttgggacaaacacttctgataatatggctccgacaagcccgatacccgctacggtatgcacctggtcgacctgaccgacatctttgccaactccaagttcaaggtctttgcgaccgccgcaaacgaggagggctctgtcgtcaaggctatcaacgccaagggcgccggtgcttgggcacgtgccaagatcgataagctcgccggcgtggcctccacgtttggcgccaagggtctggcctggatcgctttccgcgaggacggctccatcaacagccccatcgtcaagttcttctcggacgaggagatggctgccctgcgcgagcgcatggacgtcgagcccggcgatcttgtgatgttcgccgccggcccgcgcctgctctctgacgagatcctgggtggcatgcgttctcacatggccaacacactcgagatcaagcgcgagggccacgacttcctgtgggttgtcaacttcccgctgttccactgggacgaggaccgcaaggcctatgcagccgagcaccagccgttcactctgccgaccgagaccgacatcgccaagatcgaggccgacccgctggcagccggttcctgcacctacgactttgtcatggacggctttgaggccggcggcggcggtatgcgtatccacaacgccgaaatgcagatgtccatgctcaagctcctgggctttaccgaggagcgcgccgagtcgcagttcggcttcctcatggaggctctcaagtttggtgcgcccccgatgggcggcttcgccctgggcctggaccgcgtgtgcatgctgctcaccggctccgactccatccgcgacgtcatggcnnnnnnnnnnnnnnnnnnnnnnnnnnnnnnnnnnnnnnnnnnnnnnnnccagcggctccgacctcatgtcgggcgccccgagtgccgtttccggcgcccagctcaaggacgtcagcctgcgcttgatgtaggcaagcggctacctattgcctgtaacgagggaaggacgtgtgccttccctcgttttttgtgggacgggggtgcgccggtaacgtacaataactaccacgtggctgggtttgccggccgaatgtgcgatgccgcgggaggggacatggtcgagtttacaaagacgattaaagatccgttgggattgcatgcccgcccggttgcgctgctctatgacattattgccaagcatcgtagcgacgtatcggtcagcatcggcgatcgccataccgacggccgcgatgtgatggggctcatggctctctacggcgaatgtggcgaagacatcgtgttccgcgtttcgggcgtggatgaggcctcctgcgtcacatcgatcagaaacctctcgctctaacctcaacaatgtgacaaggggacaggcccctttgttgcataaattggtatgacaaggcaccgcaaagagatggtctttgcggtgcctcttttgtttcgtataggaaactttttcgaaaactgaatcgggacccttccaaaaaagttaaccacgtgctagtttaccgtctcctcgtgcagctcacgcttggcgcaatcaagcggatcctcgcccgggtcgagcttgccggcgggaatctcgactgttacgcggtcgatggcagtgcggtactgacgcaccagcacaatcttgccgctctcggtcagcgccaccacggccgccgcacccggatgacgaatgatgtcgcgggcgctgcggtggccgttgggcagctccacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcattcctctcggactttaggcatcccaggcgtcgcggccgcgcagcgcgcgcaggccgatgtcgtgacgcagggtcttgccctcaaaatcaatcttctcgcaggcctcgtaggcaaggttgcgagcgttctcgaacgtgtcgcccagagcggtcacggcaagcacgcggccaccattggtcacgagctggccgtccaccacggcagtgcccgcgtggtacacggtcacgttctccatggcctcggcatcggcgataccggtgatgaccttgcccttctcgtagctgccgggatagcccgcgctcgtcaggacaacggccacggcccactcgtcacgccagtcgagctcaatctgatcgagctcgcagttggcgcaggcgagcatgacctcgaccaggtcgttcttaaggcgcggcagcacgacctgcgtctcgggatcgccaaagcgggcattgaactccagcaccttggggccggcaggcgtgagcataaagccgccgtacaggcagccgcggtagtcgataccctcggcagcgagctctgccacggtctgctccatgaccgccaccatggtggcgtgctcctcgtcggtcacgatgggcaccgggctgtagacgcccatgccgccggtgttggggcccttgtcgccctcgagcgcgcgcttgtggtcctgcgaggtggccatggggcgcacggtcttgccgtcggtaaaggccagcagcgagcactcgggaccaacgagcatctcctcgatgaccacggtattgccggcatcgccaaaggtgccgccaaagcactcgcgcacggcctcctcggcctgctcaagttcggtcgccacgataacgcccttgcccgcggcaaggccgtcggccttcacgaccagcggagcgccctgctcgcgcacgtaggcgagagccgaagcctcgtcggtaaacgaaccataggctgccgtcgggataccggcgcgctccatgagctgcttggagaacagcttggaaccctccatctgggcgccctcggcacccgggccaaagcagggaatacctgcttgccatggtcaccataaagttatcggcagccgtgtccagcagttcaaccgaggtgtagccggcctccctcagggccgccacaacgttctttcccgaattgagcgagatctcgcgctcagcggaatgaccgcccgccaagaccgctacgtgcatgttctctaggcttttacccggcatgggcagactcctcctctataatttctgcagctgataccatattgtagcgataccctctacgtttccccaaaatcgaaannnnnnnnnnnnnnnnnnnnnnnnnnnnnnnnnnnnnnnnnnnnnnnnnnnnnnnnnnnnnnnnnnnnnnnnnnnnnnnnnnnnnnntatccgcgagctcgttgccgaacttggccagcccgccttccgcgcgaagcagctcatcgaatgggtctttgagaagaacgtttgttcgtttgatgacatgaccaaccttcccaaggctttccgcgagcagcttaaagaggcctttgccttcgatacgccgacagagctcaccaaacaggtttccaaggacggctcgcgcaagtatctgcttgagtatcacgacggcgtttccgtcgagaccgttggcatgccgcgccgtaacaagctttctgtctgtgtttccacccaggccggctgcggcatgggctgcgctttttgcgctaccggactcaacggccttaagcgttcgctgaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacgatgaggtgctcaaggccctgcgcatcctcaatgatcccgacggtatcggtattggtgcacgtcaccttaccgtctctaccagcggcgttatccccggcatccgcaagttcgccgatatccccgagcagtttacgctcgccgtgtcgctgcactccgccatccaatctacgcgcaacaagcttatgcccggcgttaaaaagtacacgctgctgcgcctccacgaggcactgcagctttataccgagaagaccggacgccgcccgacttatgagtacgccatgattgaaggcgtcaatgacacgaaccccgagatgcaggcgctttgcgacttctgcgagggaacgctgtgccatgtcaatctgattcagctcaacgacattgagggcagcccgctcaagccgtctccgatccacaaggtcgaagatcttcagcgtcgccttgagtcccgtggcattgagaccacgattcgtaattctcgtggcaacgacattgacgctgcctgcggtcagttgaagcaacgcttcaaggttcagaagaatgcataggggagtctcaccctataacgtttcatgtgaaacatagaacagccccggttgcgataatgcaaccggggctgtttcatttatttgtcattatcgatacggtagtcgtcgttgatggagccgtcctcctcgacaacgtccttggcgcccagaccgttctcgaccacgaacagcggcttctgatagcggtcgtacaggtcgttgagggtgatgcggaagcccagcggatcgatggcccagccccactggctctgctgaagatacggattcttggcgccggcgaaggcgttgccctgggtcttctcgacgtcgggattgtcagcgcccgcggagcagcgggtgctgtagtagctaaagctgatgaagtcgacggtgttgtcggccaggatctcgcggtcctcgtcggtcatgcccacatcgatgcccaggcgctcgagcttcttgacggcataggccgggtaatagccacggctctggacgtcgacgaagaagtagttgtcctggttgtcgagctgggcctggcgcacatcgcccgggcgacagctgtaggggtagtaggtgccggcagcgagcatgcagccaatcttgacctcggggtcgatctcgtgggcgatcttggtggcccaagcgctggcgacgagctcgttgtgggcggccaggtactcgacggcctccttgttctcgccctcctcaaagaccaggccggcacccataaacggcaggtgcaggatcatgttgatctcgttaaaggtgagccagtacttcaccaggcccttgtagcgggtgaagatcgtggtggccaggttcttgtagaagtcaatgagcttgcggttgcgccagccgccgtactccttgatgaggtgaatggggcagtcgaagtgcgtgatggtcacgaggggctcgatgccgtacttttggcactcgcggaacacgtcttcgtagaaagccaggccggcctcgttgggctcggtctcgtcgccgttggggaagatgcgggtccatgccaggctcatgcggaaggtcttaaagcccatctcggcaaagagggcgatgtcctccttgtagtgatggtagaaatcgatgccggtctgcgcgggatagtaatagccgtcctcgaagtcgagcatcttgcgctggccggagaccaccgcgaagcgctcggagccgtgcggggccacgtccacgttggccaggccgcggccatccacgtcgtaggcgccctcgcactggttggcggccgtcgcgccgccccacaggaagtctttacggaaagccatgcatcggtcctttcatacgctgcttgtcgtggtttcagtatcccccacaaacagcgcgccgctcaacgacaacggcgcaggtcgacacttcttttcgcacgcaggcgcccagcagccgcccgagcctgacactttctgatacccaaccaccacaaaggggacaggcacctttgtggtggttggagaccggtttgtctcgatctgtaacggaaaggccgtcaaaaccgggtcagatgttacagattgagattattcgggaggctccgctcgtttgtctcgatctgtaactggtcggaaagctcgcgggtcttggtggcgccgagctcgccgggggcaccgatgatgcgcgtgggctcggaaatgttgacggcgcgcccggacaggtagctgttgagcacctgacgcagctcgtcggccgtctggaagcgattcgccgggtccttttccatgcacttgaggatgatgcgctcaagatcggcgtcgacgccggagttgatctggctcggcgggatgggcagctcgttgacctgcttgagcgcgaccgagatcgcatcatcgccgtcaaagggcacgcggccggtggcgcactcgtacataacgacgcccagcgagtagatatccgaggtggggcccaggtcctgaccgcgtgtctgctcggggcttacgtagtgagcggtgcccagcacgttgttgtcctgcgtgaggtggctgttcttggcgcgtgcgatgccaaagtccatgaccttgatattgccgtcgggcagcaccatgatgttttgcggcttgatgtcgcggtggatgatctcgtgcttgtgtgcgaccgaaagcgcagagctgatctgcgagccgatctgcgcgacctttttggggtcgagggctccatggctcttgatgccgctcttgaggtcggtgccgcgcaggtactccatgacgatgtaataggtgtcgccgtccttgccccaatcgtagacgcccacgatatagggggaggagagaccggctgctgcctgggcctcctgcttaaagcgtgcggcgaaggttgcgtcgccggcatactgtggcagcatgatcttgacggctaccgtgcggtcgaggacctggtcctgcgcacggtagacggtcgccatgccgcctgttcccaccttatccttgaggaggtatcttcccccgaggaccctctgttccattcctgctcctaacataactattcgctcaacgatgtgtgtagtaccttcgatgtggccgctggggccgtgtggcgcgttgccgctaactcttcggccgcggcgtgcctcgggtgtccgattcggtcatgggcatcacgctccctgtgcggcaagcgccgcggtcaggacgatgccggcgatcttggcggcctcgacgtcatgcttgtcgtaatnnnnnnnnnnccaccgagatggcgaccgtgggtgaatcgtaaggtgcaaagccaacgaacatcgagttgacgttggtgccgccggtctcggccgagccggtcttgccggcgaccttgacgccggggatttgggcatcggtgccggtgccggactggacgacggcaagcatggcctgcttgacctggtcggccgtggcggagctgacggcctgacccagcgagcgggactgcgtggtcttgaccacggttccgtccggggcgagtacctgggctacaaagtacgggtccatgaccacgccgctgttagcgatggcggcggcaatcacggcgttttgcatgacctgctgaaccgctcttccgatctgtatggtattcatcgatattgggatggagaatcagctaatttagccccgtcccaaaaagactggtcaagctaacggaacgccgtagctaaaaatccccgtcccagaaaaatcattgcgcaggtaggacggcaaaggtagctagaaaagccccatcctaaatgagctacaagatttcggctaggagcgctcggcgcccgtttgttttatcactgcaggtagaaagcgcgatgatgcgtgcatcggggccaacgtcatccatgttctcgtgcaccgccgtctgcgagacatgcgtgagcagcgtctgcatcgaggcctggtccaggtttcccggcccaaagataatgtcatcactcgcagcaaacgagcacacggcaacaatgcgcaggcggaacgccccgtcctttgtgtagagcgtgcccgtgcggtgcaggtcaaagaagcccctgtctaaaaaccggtcgacatcgccaaacatcgcaccgttatccatgtggtgcgcatagagcagattgtaggaatcggtcatcgcgcgactgttgcgcgtatccaaaaacaccgctcccgaaaccgcggactcccccaacgcgtttttgttgaggtattcctggttatcttttccctgaacaaagggatagtcgatgttggtgccatcgatggtgacccatccgaccacgtcggaatttttggtcatcagttcctgcaggcgtgcgcaatcgttggccccggtgggtttgtagtgcagcagctcatcgctgatgaacccgccgttcataacattgtttgtatcccacagcgaatagcccccgtacagcagcatgagcagcacgagaaagccggcaaaccacgtaagtacgcggtcgccggctctcgccagccgagctatgcgtttaagctccatcggctgtaatcctcgctgttttaacggcggttacgacgaggacggaagaagaccacgcccatcacggcagcaaacgcgacgattgccgcatagggaacgaccgtccgaataacatcggtcggaacggtaacatccttggtattggtaaagatcaccgtggtgtcgtaagcaccgatagcttcctcggcaatagagctaccttctgtcgaattggtgccatcaccaatcttgtacgacgtcttataaccgtcgccatgataatccgcctcagttacggcgaatttatcctccgatgagagaccgtaaacgatgacggattccccatgcttaagcgtctcggtaaacgtagctcccggcttggttgtagtttggttcatggtagtaacaccgtttttcacagtgccatacttataagtctccccgtcagcgcctttaatcgtgacggtaaactcaaagtccttatttttatcgccctggttaccggctacgacctttgtgatggtcagcttatgggtgacatagggccagggcggcaagctcccgagagcctacctcctcgtgaaagccctcgatgcgatagttggaaggatgaaccttgaggatcatggccgtatcgggtgtgatggcttgctcataatctgccaggtgcgtgcggttggtggcgccgacctcgacgagtttggtgcccgaagccgccatgacgtcggggatgcggaagctgccaccgatctcgacgagctcgccgcggctgactatgacctctttgcccgcggcatgggttgccagcaccagcagcaccgcggcggcgttgttgttgaccacgagcgcgtcctcggcaccggtgagcgagcgaatcagctgcgcggcatgctccttgcgcgacccgcgcgaacaggtgtccacgctgtactcgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcaatggccgaggctaactcgcgcttggaacgcggagcggcgccggcacgaatcgcggcgcgctcctcgtcgagctcggccgtgacggcggcatgcgccaccgcgtcgcaggtctcccccgccgccttcaccaccggccactcggtaagcagctcgttgacggaaggaatggcgcgcaggtgggcgcgcacctcatcggacatcttctggctatcgctcatgtgcggcctttcaaaagaaacgtggatcagtcgaatacatcagctgagtcaattactcgtcattatccccgcgcgcgacaatcttttccacgcgaacggcgttttcctgggtgagcgcggcgcccgtcaacgggtcccaacgcaatggcgtatggtcgagcgggcccacgcccaaggcttgagcgccaccggcatcggcgccaaacgaacgtccgccgggggcggccgatgtaaagatgcacgccggatgcagatacggcgtcgtctccacgcgcacgcggtcgcggcccatatcgctcacgagctcgatgatctcgccgtcggcgatgcccatgcgcgtagcagcatcggcattcatctgcacggtatccaggtccgatccagcctcggcggcaccttgggccgcaagcctgcgcgaggtatgcgactcaaagggtcgattgccgctaatgaggcgaaacattcctgggtcgggctccaccatgggagcgatccagttgggtacacgacccagaccggctcgttcccatacgtcgcttgccagcgcaattttgccgccatccaggggaatcgccggctcgcccgtacgcgacggcaacgcaacacccgtgtcggcccagcctcgctccttgagtgcggcaagatcgatcccaaacggtgccacctgggcggcggccattgagctcgaccttcacgcccaggccgggcagaatcttctcgtagtactcgaccgagcgcatgatctcgtccttgcgcgggggcgcggccgccagcacaatctgaccgcccagatgatcgctcgcctcgtagacggtcacgtcgtagccgcgcttggccgccacgcgcgcggcctccaggccggcaataccgccgcccaccacggcaatcttcttgtcgccctcgcccggcttaatggcgatggtcgcctcgtctccgttctcggcattgagcacgcacgagatgtacttgcggttttgaatcgcgtcgacgcagcccttgttgcagttgaggcactcgcggatgggctcgcccgtggcggccttcagcgcaatgtcggggtcgcacatgagcgagcggccgtacgcgatgatatcggccgaaccgtcttccaggatcttctcgccggcctcgaccgagacaacgcggccgacggttgccaccggcacggagaccagggccttgacgcgctcggccacgggcagcgtccagttgtagggcatggcgcccatgggcggaatggtgtcgcccatgttgccggtatggttggcctgtgcaacctggatcatgtcgatgccggcgccctcgagcagcttggcaaactcgcaggcctcatcgggctgcaggccgcccttgccgcgcggcgtgccgtcggggttctccatgatcacggggagcttgtactccaccatcagctgcggcgcggcttccctaatggcggcgacaacctcgagcgcatagcgaacgcggttctcgaacgagccaccgtactcgtcggtgcgctggttgaggatggccgagcacagcgaacccaccagacggtcgccgtgaacctcgatggcgtcgatgccggcctgctgcgcgcgggcggccgaggcagcgatggcctccttgatctgggtgagctgctctacgctcgcctcgttcacaaagtgctgcatgtcgtggtgcagcttggcgtaggcctgcttgcggatctcgttggactcggccatcttggcggcaaaggtctcctcgtcgccggcggccttggcctcctgcgcagccttggcggcggccatggaacccatgaccatgcggccgacgccgggcacgtcgtactcggggtggaacagctgcagcgcgaccttggcgccgtgcttgtgaacggcgtcggccagcgccttaaacgtggggatctgggcgtcggtcgctaacttgggcgtggggcttgcggtcataacaggagcaacgtcgccgatgacgatgtagctcacgccgccacgggccaggcgctcgtaaaaagccaggctgcgctcgccaatggaaccgtcgcgctcctcgtagccggtggtcagcggcgggaatccgccgccgaagagccaggaaacagcccagttgatggcttaagcatacgcggcaacagacgcccttccaagcaaccgttggttgcacgacgggggaccgcggcgaagaattgcgcgcaacgccccacacctccatgccgtacaatgaccggcatggaacctattgcacacatacataccgacctgccgcagaagttcggcattccgcgcaacagctttttggcgcctcatctgcagggacgcatcgtttttgagccggaatttgcctccaatgcagcggtcgagggcctggactccttctctcannnnnnnnnnnnnnnnnttgtggcgcttcgaaaacggcacgctcggcggcacggctaaggacatagctaccgatgccaagacgcaggacaggtccggcaccaatgccaagtggtcgaaaaccgtgcgcccgccgcgtctgggtggagccgagcgcgtgggcgtgtttgccacgcgcagtccgtttcgccctaatcccatcgggcttacctgcgtcaggctcgatcgtgtcgagcttaccgacgacggccccatcatccatgtgctgggggccgacctgcgcgacggcacgcccatctacgacatcaagccctatattccgtttgcggactgccatccggatgcgacgggtggctggatcgaagacgccccgtggcaagagctcgacgtcgagtttccacaagcgctgcaagacgaggtcccgcccacaaagctgcccggtttgannnnnnnnnnnnnnnnnnnnnnnnnnnnnnnnnnnnnnnnnnnnnnnnagatccgcgccgtgctggaagcaagcacgagcccaatcgcgtctaccacttggcctactccgggctcgatatttcgtttacggtcgatgggacacagctgactgtaacggccgtcaccgaagctcaggactagctgtccgcccgcccacatcagtcaaattcaaccccaaaacccgtgccaaagccgcccgtcctgatggacaataacgcctaccgaaccaatccactttgcacgggagcccagcatgaaatacgacttcacctcgcttatcgaccgccacggtatggatgccatcgccgttgactcctggggcgagatccccggtatggcgccaaacgcacccgatgagggcttcgaccgcatccccatgtgggtggcggatatgaactttgccaccgtccctacggtccaggagcacatcattcagcgtgcccagcatcccatgtttggctactttgatccgcgcgccgagtacttcgacagcatcatcgaatggcagagccgtcgcaacggcgttgagggcctgcttcccgagcatatcggctacgagaacggcgtgctgggcggcgtcgtgtcgacgctgcgcgcgtacgttcagccgggcgacgcggtgctggtccatagtcccacctacatcggttttatgagctccaccgcctccagcatatgggatgccatcagctcggcgataggcgcggccatcaatgccatcagctccaccatatcggcggtgctgtcggcaattcaggcggtgtgggactccatatggggtgccgtgagcagcacggcgtcgagcgtgtggggcggcatcagctccaccatatccagcatcgtgaacggcatccgcgacacgatctccagcgtgttcaacgccgccaaggacaccgtgagcagcgtgtggaactccatcaagagcgccatcgagacgccgatacagaacgcccgcgacaccgtgcgcaacgtcatcgactccatcaaggggttcttcaacttctcnnnnnnnnnnctacggcaagggcaacgcctgcctgtatgcgcgctccgccaccgcgactccatcaaggggttcttcaacttctcgtggtcgctgccccacctgaagctgccgcacctgtccatctccggcagcttcagcatcgccccgccgagcgtgccgcacttcggcgtcgactggtacgccaagggcgccgtgttcaacggccccagcgtcatcggcgtcggcgaggcgggccccgagggcgtggtgccgttcaacgagcgcggcgcgcgcccgctggccgagggcatcgccaagctgctcgacggcaagggcggcgcggcccatggcgacacgaacgtgacaatcaacctgtacgcgaccgtgcgggaggaggccgacatcgagaaaatctcccgccagatagccaaggaaatcaaacggcaggagtgcttcgcatgatatacaacggcttcgacttcgcgccgtggttcgacacccggctcgtgacccgctcgctgctgcccgagtacgaaatcgccacgcgcgacgtgcccgggcagcccggctcgcgcttcatgcgcgcagagctgaaacccctgacgatagacgtggcggcggcgtggagggcgcgccccgccgacgacatggcggcccttcgccgcctcatggcctcgcgcctgctgtgcctcaaggaggccgagctgtggctggacgacgagaggcacctgggcctgcgctacatggccgtgctgacctcgccgggcgcgctcgacacgttgtggcacaccggcgaggccacgctgacgttcacggcatacgaccccgtggcctacggggccgaggggcgcgcaaccgtgtcgggcacctcgggcgtgcaggtgggcgggacgttccgcacctaccccaccgtgaccgtcaggcccggcggcagcacgtcggcgctgcggctgacgaacatgggcacgggcgagttcgtgcagatcgacaaggcggtgacggcatcgagcgcggtggtcatcgacatggccgccccgcaggccacggtggacggcagccccgcgcccgtgactccgagtccgacttctacatggccgatcacgtgggcacgttctgcctggtcgagaatggcctgacgagcgccggcgcgcccgagttcctggctgcttgcgagaacgctttcgttacgcgcggcaaaattgtcgacggttgggcggcgacggcagagttgctggtcgcggcgcgttcgtagcgcggcgtcgccgcacttggacatgtcttttcgagagagactggtgaggtaatgtccgatatcgagaatccggcaggcgacacgcgcccgattggcgtgttcgattctggtttgggcggtctgacggttgcgcgcgccatcgcgacggcgctgccgcatgagtccgtctactacttcggcgacaccaaacgctgcccctacggcacgcgcaccgaggatgaggtgcgctcgtttgcgttgcaggcgggccgttggctgtcgaagcacgacgtcaagattatggtcatcgcctgcaacacggcgacagctgcggccttgcgtctggcccagcaggtgctcgacgttcccgtgatcggcgtgatcgcgccgggtgcccgtgcggcaatcaacagcacccgcacgcgtcgcgtaggcgtgctcgccaccaacctcaccattcgctcgggcgcttacacgcgcgccattcaggacctagatgccggcgtcgacgtatacggctgccccgcctcgagctttgtcgaggttgtcgaacacgagctcgcctcgggtgcgcatctgcaagagcagtggcttgagaacgaggacatcttcgatacgcctgccgtgcgtgcgctggtgggtgccacggttgagccactgcgcgaccacggtatcgataccgtggtgctcggctgtacgcattttccgctgttggtgggacctatccgccatgcgctggggcctggggtacgcgtcgtgagttccgccgaggagaccacgcgcgagctgaccgatatcctcacgcgccgcgagcagctggcgggcgtcgccgccgagccgcagcatcgttttgccacgacggccgataacattgccgagtttgcggtggcgggcagctttatctttggtcagccgctcaagagcattgagcatatcgatatcgatgagctgaaatagatgtaaggccgccgtcagagccttcgccacaccttttgccgaaaggatttttctatggagtcaaccgcgccaacggtcgcgccgccaacgagttgcgccccgttaagctcacccgtggcgtcatgaagcacgcccacggctcgtgttttgccgagttcggtgacacgcgcgtgttgtgcgccgccaccatcgaggagggtgtgccgggttggcgaaagggagctaaggccggctgggtgaccgcggaatacgccatgctgccggcgtcgaccggcaagcgctgcttgctcgctcgccgcgcgcaaacgcttcatcgagccaaaatggcgcataagggcacgttttctggtgggtcccacgcctggaacgtcatcgagtaccgaaaccgtcatggctttatcgcgcaattcgcgatggaacgtgatggcaaaacggtgcgattcatcgcgcacctgtttaattagatagagcgacgcggacccggtcggcagcacgacgggagtctcgtcccaaggcacgaaaacctcctcatcggcctttgccaagccacaaactggtatatcgagcccaagagcctcaagttgcttgatcgcagcggtcaattgcggcttaccgccatcgacaacgagcaaatcggggcgcgagccaaannnnnnnnnnnnnnnnnnnnnnnnnnnnatgcgctcgggagcataacgtcgtcccaaaacctcggacatcgacacgaagtcgtttgcctcgtccaattcggcctggattttaaaacgacgatactggctcttgtcggcgcgcccgttggtaaacaccaccatcgaggcgaccgtaaaggtgccatgcagcgtcgagatatcgaagcactcgatacgcaacggcggcgatggcagcgccaacgcactttcgagctccaggagcgcttgattggtgcggtcgtcagcgtaccccgttcgcatcatgtagcgcatgagggcatggcgcgcatttttggatgccatatcgagcagacggtgcttttcgccacgctgcggcctatggagatgacaggaacgctcacgcttgcccgcaagccactcccccagcgcctccgcatcctcaagctcgacggaaaggttgacctcagctggaatatcagccgtctcgtcgtaatagcgcttaagaaagcccgactggagctcttcctcgtcaacatcaagacccttgtcgagaatgaactcgcaggtgcgaactgttcgaccctcgcgaacgacgaagacgcaagcggcggagatggtctcctcgcgatagaaaccgatgacatcgatatcgacactggagggaaaaacgacttgctgacgatcgtccagacccctgatgacctccaaacgacgtttgacgcgggcggcgcgctcaaaatcgagcgcctcggcggcctccgtcatctcggatgtcagctcgtcgacgacgtccttgcgatggcccgacaaaaaacgttcgacacgcttgacgttcttggcatagtctgccggggaaaccgcgccgacacacgcacccgggccgcgcccgacatgatagtcgaagcaggggcgcccgttttgcgcgcaaatcatattgacgatgtcttcctcgcccttgtgggactcgatgatacggcgacaacgacgccactccgcacaggatgcggagcagatggggataatacgtcctgcgcttgacgagcctgcgcccaatgagctgacggcatttgtcacgcagctggcgcacctgcgctcggcaaacgacgcggcggcccgcgccctcaactacggcgcctatcgcaacgtggtgatccagaacaagcagctgctgttcgagcgcgcctgcgacgacgcgacggtgctcgtggcggtcaatgccgtgaacgagccctatacctttggagccggcgaactcaacgggtcctttgtcgacctgcttgccgacgatgcgcccacggtcgagctgtcgagctcacttgaacttgcgccctatgaggtgcgttatctgctgagggcctaattcatgactgcgccggacgagggctatcagcatattgagcatgggcttgagcccgtgtttgacgagcgctcgcgcgttttggtgctggggtcgtttccctcggtgctctcgcgtgccaatgccttttactatggcaatccgcagaaccgcttttggcgcgtgatggccgcgtgccttggtgcgcccgtgccgcccaacgagggagactctttggcgagcggcgagcccgcgacgctcgatgcctcgattgccgccaagcgggctatgctgctgaacggcggcgtggccctgtgggacgtgatcgagagctgcgacattaagggttcgagtgacgccagcatcaaaaacgtcgttccggcgcatgtcgagcgcattaccggcgcagctcccattgagcaggtgatatgcaacggtggtacagctggtcggctctacaagcgctatctacaagaacgcaccgggctgccggccatcgttctgccgtcgacaagtcccgccaatgcggcatggcgcctagagcgccttgttgggcgctggcgcgaggccgttgactggggcgctctgtaatttagatatctgattgggcgcgggtgccgaggcgtttcatgatggcatgccagatcggtgcgggcagcgcgggcttgacgcgcaccatgccgtcggcatcgacgctaccggcattgccgccgccaagcagctgcgcatgctcaatggagcagcccatgcgcacagcgcccatcgcttccgaaaatggccgacgcaagaggcccatacgcggggagtggcgaagcgccgcaatgccgctgccggcacagatgacaacgccgtcgcaccatggcaggtcacgtagaagacatgcccgatacaggcggtcgagaacttcgtccgcctgcttgttgtttttggacgcggcctggacgacgacatagatgcgtgtctctgtatttccaaggcgatcgagtatctgctcgacagcgatcatagcctcatcgtcaaatgcatcatcaacagcgagcaccatgccatcgattggcgcgttgacgaacatgtgccgcccggcaaaacgcccagccctggaccttgccagcagcgtcagtcatcgtgttcatgtattcctccctacatcatcccgcctgctcccagcagcgggcccaatatggacagaagcaacgccggcaagatgagcgtgccggtgggaatcagcagcttgacgggcacacgctcgatctcgcgctcgaccgcagcgcgatgagccgcacggatctcgcgactttgagcggccagcgtctcggcaagtggggcacccagggcgagcgcctgccccaccgtgatggcaaaggtctcgagcgctcgcacgtccaggtcgcgcgcggcggccaacaactcgtcctcacgcgtgcccacgcccacctgccacgccatgcaggcccgctcaaggcgaagagccagcactgaccggcggttggcgcagaaaatctcaagcgccgcatcaaacgaaagaccggccgaaagacccaagcgcacaacatcgatcatctcggacacttcgccgagcgacactcgcgccgggccgcccactccaaccgcgcccttcactcgcgcggtcagggcatcgaccactgagcgacccgcggcagcgaccagcaccgcctcgcgcttgcaggcccctgcgatcttgcgtgcatccgcccgatccaaacccgtcgcgacaaatacactcagggcgcacaggcaagccgcaactgcaaccggggcgctcatagctccacccgcataatgcgtcggataaccaccagggcaacggcattgagggcaagacccagcaccacagcgcccacgccggcaggcgtcgcaagaccgcgacgaaaatctgccgaaagcagcgccaacaccgcgcacatgcccgccggcatcgccgcgaccatatgcgcagacatgcgagcctgcgacgtcttgacatccaggcggcgcttgagctcaatgcgctcccccaccatgctcgacgcctcggacagtaagtcggcaagcggagcaccggtgcgctgagacaccttaagcgccaaggtcacaagcgaaaggccgggagcgtcgatgcgcacgagcaagtcatcgagcgcgtcggtcgccgagataccgcaatcgatcgccgccgccacccnnnnnnnnnnaaaactcggtatgcaccggttcttgcgcatgagcgcccacaaagcgcatgccctgggccagcgaatgtcccgaggcaagcgacatggaaagtgcggtaaacgcctcgggcattgcctcttctgcatcgtgttgctcgcgccggctctcaaagccatcccgagcggcgccagcggcaatcggagcaacaagtcccaaggcaaacccgaggggcgataacgacattcaccggtgcgacagttccgccgtactacgactccatgctcggcaagctcatcgtgtgtgcgcccacgcgtgacggcgccattcgcaagatgcgctcggccctgggcgagctcgtgattgagggcgtgagcgaaaacagcgagcttcagctcgacgtgctggcaaacgacgagttcttgtcgggcatgtatcacaccgatctgatggggcatctctatgctgatgaatagaaaagcgaagacggtcaatgtccttgaggggccgataaccgagtcgtgcgccgagtttcccgcgcgccacgtgtttatcaagtgcccggagtgccgtcgcgtgatcgatgaggcacgcctgcacgataacctggaggtctgccctcgttgcggcaaacactttcgtgtgagcggtcgcgcgcgcatgcgcatgacggtcgacgagggcacgtttgaggaatgggatgccaatctggcgtcggaggacttcctctcgtttcccggctatgccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgcatttgagcgtgcgaccgagctgggattgccagttgtcggctttaccgtttcgggcggtgcgcgcatgcaagagggcgtgacctcgcttatgcagatggccaagatttctgcggcggttaggtgccacagcgaggcgggcggcctgtatatcacggtgctcaccgaccccacgaccggaggtgtaaccgcgagctttgccatggagggtgacattatcctggccgagcccgatgccctgacggcatttgccggcccgcgcgtgatcgagcagaacatgcacaagcgtctgcccaagggattccagcgctccgagtttttgctggagcacggcttttgcgatgnnnnnnnnnnnnnnnnnnnnnnnnnnnnnnnnnnnnnnnnnnnnnnnnnntccgcgtggcgagattgcgctcacggtaggcgagctgttggcgctgcacgaagggcatgcgcccggcctgggggcaccgcatgagattgtgcatgcgggtcgccgcggcaaaaagctgggacacttgtttaagcgctcgccggcaccaaaaaccgcgctcgagattgtcaagcagacccgctcggcagatcgcgccacggcgggtgagatgatctcgctgggcctggatggatttgtggagctgcacggcgaccgttactttggcgacgacgccgctgtggtggctggcattggctggaaagacggacgccccgtaataatcatggggcggtgctcgcgcgcgtaccgcccacgctattagagaggattagcagatgaccaacgaagagctgcagaaggaaatgatcgcggccatgaaggccaaggacaaggttcgcctgtccatcattcgccaggttaaggccgaggtgaagaatatcgaggtcaacgagcgccgcgatgtgaccgaggaagacgtcaacagcatgatcaagcgtctgatcaagcagacgagcgagacgctggagatgtccatcaaggccggcaccgaccaagagcgtaccgacaacctgaccgagcaggtcaagattctggagagccttctgcccgcgcaggtttcgggcgaggagctcgaggccctgatcgagcagctcatcgccgagctgggcgccacgtccaagaagcagatgggccaggttatgggtgcactcggcaaggccactggcggcaacttcgataagccggccgcggcaaagatcgtcggcgcaaaattggcgtaatttgttaagcggttttatcaaaccgcgtaacggctcgacgctgcaaacccgtacacacggcaatctgacgttcaatttcaagggcgcgaccataaggtctgcgccctttcatttcacgtcaccttgctcgcgtgtacgggttttcgctgacttatgctcaacaagggcggttagattannnnnnnnnnnnnnnnnnnnnnnnnnnnnnnnnnnnnnnnnnnnatgagtgggcggaaggttgcgggttctttacgggaatgtagtgtgggctgcggaaacgtggttctttccgtacaatagttcaactcgtgtaaacgcagggaagggacattcatggcagacatgatcgagatcaagcatctcaacaagtactttggcgacctgcatgtgctcaaagatatcaatctcaccgtcaagcgcggcgagaagctcgtaatgatcgggccttccggctcgggcaagtcgacgctcatccgttgcgtcgattatctggaggagcccacgtcgggcgaggtcatcatcgacggtacgccgcttaccaaaaagaatcacctggagatggctcgcaagtatagttccatggtgtttcagcagttcaacctgtatcccaacatgacggtgctgggcaacctgacgctcgcgcccatcaagctacaaaagaagagcaaggaggaggcgaccgagatcgccatcgccgcgctcaaacgcgtcggcatggcgcataaggccggcgagtatccgcagaacctctcgggcggtcagcagcagcgtatcgccatcgcccgcgccctgtgcaccaagcagcccatcatcctgtttgacgagccgacctcggcactcgaccccttgacgcaggccgcgccgccgaaggccaggcgcaaggttttcgtagattccgcacgagccggaaagcacttaatgtgctttccgagcgagccaggactgcccgagcagcgaactaaacaggcagaccgcccaggagattcccatgatcaagatcaccgtccccgccaccagcgccaacctaggcattggctacgacaccctcggcatggccgtcagcctctactcgcacttcaccttcgagcgcgccgacaagctcaccatcacgggctgccccgaggagttccaaaacgagaacaacctggtctacgtgagctttgtcgatgccttggccgcctggggcgagccggccttccctgtcgccatcgacattcagactgacgtgcccgtcgcccgcggcctgggctccagctccacctgtgtcgtcgctggcatcatggcagccgccgcgctgacgggccacaccgtcgaccgcgccgagctcgttcgcatcgccaccgaggttgagggccatcccgataacgtcgcccccgccatcctgggcggcgccgtctgctcctttacgccgacggactcgcttccccagtgccttcgctacgaagtgagcgacaaactgcgttttattaccgtaatcccgccctacgaggtgcatacgagtgaggcgcgcaaggtcgtgccgcaggagattccactctccaccgccgtatggcaaatgggccgcatcgccggcatgacgcgcggcctggagaccggcgaccttgacctgattgccgccgccaacgacgaccgcatccaggagccctatcgccgccgcctgattcccgattacaacgccgtgcgcgacacctgccttaatggcggcgccaagaccatctggatcagtggctccggctcgacccttatggctgtaaccgatgacactatcgtagccaagttcctgcaggtcaagctgcgtgagcagttccccaaatgtgacacgcatattctgacgtgcgacacggaaggcgctcaaatcgagtacctgtagacatcctcctcatatacctgtccgggacggtcgggatgttccctcaaaatcgtcctcgcgcatgaaggccccttgtcctgctcctacggagcgacggacaaggggccttcgcgctgcggaatgattttgagggaacatcccgaccgtccctgcgcctaccttgctgaggatgtctacagggacccacgctttgaaggggcgccgggctgatggtttggctttttattggtgggggcccttactgggatgggacccttactagaggcaggcctcggcgatgcggcgcttgagttcatcgataccggtgccagtctgggattatggcatcgcagcgagccggttccaagtgccccaggtcgccccgaaagaggagcgacgcgtactttggtacgcgagcgacggcttgagtggcgagatggggtgcttggggccggcgcagcgtcaagccttaaaggtggttaccagggtgttctggcggtagaggactcgatggcctcgtggcgcttgagctcgcggcgcatggtttgcgaattgagccaggctgcctgccagccacggatagggtagtacgcttcgtcaagttcaaactgcgtatagccgcaggcgttgatgattgttgccccgcatgcatgtcgacgctcacgctgaaaatcgtggccatagcattggtgcacatgcccgtgcaccatatagtcggccccccaggactcgagcgccgtgttaaagcattcgaatcctcgatgtggcagatcatccagatcgcccacgccggcggcgggtgcatgggtgagcaagatgtcgcagccgccgaccatcctcactttgcgggacagcttgcgcatgcgcttggccatttcgtgctcggtgtacatgttggcaccgtctcggtagnnnnnnnnnnnnnnnnnnnnnnnnnnnnnnnnncgcatggagccgccaagccccgcgatgcggacgccgcggtacacgtagacggcatcttcgacacagatgcagccgcccggtgcatgacgtacgtagcggtcatcgtggttgcctcgcacgtagatgagcggtttgttgatgacggtgaccaaaaactcaagatagtccgggtccagatcgccagcggacaaaatcaagtcaacaccctcaaagcgttccttgcgaaagcattcccaaaggcatcgctcttcggtatcggctacggcaaggatcttcatagggcgtggactttcggctcatcgttgggctgcggaatggcacctaccacgttgtcggccagccagtccatctcgacgatttgcgtgctcggnnnnnnnnnnagccctcgatctgcaccacgccgtcttggctatggagctcgccgccaaatggattgatggagccctcgacgatgccattgcggaggagctgaacaagcttgcgcgtctgatagggcaggcccggagcgtagcgaatgtcgattacgcccgagctcataccataccagtagttgacggcgcgaacctggctatcgtcactggtctcatcccaggtgccatgcagcaggcttcgcacgataagctcgtagtatcggccccagttccataccggcatggcaatgccgacgaccttgccatcgaccaggcggtggagtccgtaggccgtggggtcttcgagtgactttgacatgtcgggcctttcgctgtttggtgtgggtgggtctgtcaggtggtgacggtgctgaggtcgagtttgccgcaggtcaggtagatcatggtgctgaagtagtccatgttcttgaatccgcgggctcgggtcttgacgttctggatgacgctgttgagtccttcgaggatcgcgttggtgtacgggtggtcgaagtaggcgaggatgtcccgccagtggcggcgtatctggcgggcgaactctttcatgggttcgagtcgggagcgcgtcatccacgagcacagacgcttgagggccgtctcggcctcggctcgatcggcgctggtgtcgtagatgtcctggagggtctcgcgcatctgacaggcgcgtccggttttcaatcgtcgccgttgcaggctgcgcttggtttccaattgcaggccggtcaggttcgattcgttcctcaaccacaggtacttggtccgcttgagcagcgcgttgccgcgggcctcctgtttgcggaccttgtcgacggcctcgttggcgtgtttgatcacgtggaacttgtcgatgattctcgccgcgttgggcagccgctcgcggatgcccttggcgaaccccaggctcatgtcgcaggtaaccagacgcacccggtcgggatcgccgttgtggtccatgaaatcccgcgcgaaccgtttgatcgtggtcgagtccttgcccgggaccacgcagattacgttgcgctccaccaggtcggcgaccacggtgatgtaccggtggcccttccggctggtctcgtcgatgcctatggcctccacgcccgtgtagtcctcgtaaagcctcgcctcgtccacgtaatggcggatgaaccgccacaggcgggtgtcatgttcgccgacctgctcggcgatgtccgcgaccggctggcttttggccagctccacgaccatcgcctcgaacaggagcgtgaacccgcttcccggcctcgcccacggcaccgggaccgcgtgcacgccgtgggcggggcacgtcacgcgcggcacgcccgcgtgaatgaacgccttgtactggaagaagttcagatgccgccacacgcgctccctcgcgtcatgcaccggacacgcggcctcgccgcaccccggttccgggcaggggaaccgcgaacccgccgcgaacccgatcgcgatatgcagttcccgtctgccgtcctcctcgtcacggaactccacgcccgacaccctccacgggtcaggcagttgcagggcggcggtgaacaacgacgtggtatccatacccccaaactacccgaccagcaccaccaccccccgacccactcacccacaccaaacagcgaaaggccccgttcccgcgcgcacggttatgcgcgcgccaacgctcggcaagctcggcgtcgtcgagcgcatcgatctcggagcccagcaagacgttactcgcgtcgatgccgatctgctcgcagacggtggcggccacgcggtcgttgtcgccggttaagaccttgaccgccacgcccttggcctcgagggtggcgacggcgccggcggcacttgccttgggcggatcgaggaaggccaaaaagcccatcagcaccatgtcgcactcgtcggcgatgccaaactcacccacgcagcgcggattggtcttttgcgccacggcgatcacgcgcaggccctcggcattgagttcggcgacttgcttgcgaatctgggcgagcttattttcgctgagcggctgggcgacacagtcaacctcgacaaaggagcaaatctcgagcatttcctcggcagctcccttggtaaccatctgggttttgccctgggcgtcggcgacgactacgctcaggcgacggcgtgagaaatcgaagggcacctcgtcgaccttggtatagcggtcgcgcaggctctggcccagcgtggagtcgggcgcgacagtcgagggcgtcacgtcggcacggtcgatgacggccaggtcgataaggtttttgaggccggtctggaagaagctgttcaaaaacgcatggcgcagcacgcgtgcgtcctcgttgccgtcagtgttgagatagcgctcgagcacgatgcggtcttcggtgagggtgccggtcttgtcacagcacaggacgtccatggcaccgaggttttggatcgccggcagctccttgacgataacctggcggcgggcgaggtccttggcgccctgcgacaggctcgtggtcacgatgacgggaagcatctgcggcgtgatgcccacggccacgctcgtggcgaacagcagcgcgtcgatgacgctgcccttggtggcggcgttgatggcaaagacggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgagcatcttggcgatgccgcccaggtaggtgtccgagccggtggcaacgacaagtgctatagcggtgccgttttgcacggaggtgccggtaaagacgatgtttttgcaggcagagagcggcagcgcggggctgccggcaccctcggcgacggtgatggcagcggtcttttcgacggcctcgctctcgccggtgagtgcggactcgatcacaaagtggtcacgctcgagggacggcatcgttattccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatagctggatcggcaggacggacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatctgagtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgtacccttcgacatcgacggggcgcgcctgctctaccagatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatatcgccagagagctggccgggcgccacggcggagttgccgcagtacgggcaggtggtgacggcgacggtgccgtcggacacgagctcggcgccgcacgacgagcagatgtagccggcgttttgggcgagttcctgcaccgcgtcgtcggcgacgggcttgggcgttgcggctgctgcatcggctttggcatctgccttgtcctggcgctcgcgatagagggcctcgacttcttcgacttcaaaacgagaatcgcagtagtcgcagacgagcttttgctcggcactggcaaagtgaagggggccgccacacgcggggcattgatagttgatgctctcaaaggccatgatcggtcctttcgctgccggaggctatgcgccgatggcgccgccgcagtattcgcagcgcccgctggcatcgggaatggtggtggctccgcagaaggggcaggtcaccgcggtcttgggggctttggcggccacgacgctgtcgcgcgtctcctggcgcagctgcaccagcgcatcgcggacttcggttgcctggcgcttggcctcgcgatattcgatggagccgcgctgatcgatggtggagtcgttcacgcgcaggttgatctcggtaaagtacggcgtgttgacgtggatggtcagattaaagtcgtaatccaggtcgtagcgcggcgggttgtagctctcgcgctcgccgtccttggtctcgcgatagatctcggtgcggtgctcgtcgatatccatatcgcagccgagtacctgcgagaactcgatgatgtcgggattggcatcgcgccagcggctctgcgaagtgatgatcagcaggcccgcgtcctcatcgagcataatattggtgcgcccggccgagagtgtgcgcgtggggttgaacgacgccaggcgttcggcattggcctcgcggtaggcgagttgctcgcggatatcgtccgcggtgctggaacgataaccgtcaaagaagggggagagcttgccgacgcactctttgcacaggtagcctnnnnnnnnnnnnnnnnnnnnnnnnnnnnnnnnnnnnnnnnnnnnnnnnnnnnnnnnnnnnnnnnnngtcttacctagaagtcccagctcggtaccgcaaatcgcgcactctttcttctcgaacatcttgtcaaagaagcccatggctgcctcccatcaacaggtagcgtgtgtcacttttgatgatgggcgagtatgcagcctttcacgatacccaagcggctcaagaagtctccacaactgggacacaaggcccattttgggaagtcatcggggacgttcttaaacgacctggaccaccgcgggcgcggccttagccacaaagccctcgttggcgagcgtcttctcgcagccggcgagctccttctgggccgcggcgatctccttctccagacgtgccttctcagcggaaagatccaccttgccctcgagcaccacaaagacctcgacgccgctgtcgaccacggcgatgctcgcggccggcttctcaacgtcggtgcccataaccagcgaagacgtgttggccagcggctcgatggtcgagcgcaggctctcgagcttctcgatgtcctcggcaccagcgcgcacgaccacgtcgagctcggccttggggctcaagcgatagcgcgaacgcgtggcgcgggcggcggaacagctcaaacgcgcgctcggcgtcctcgtcgacatacttggcgtagtcggcgggctcgggccacttggcgatcatgagcgcctcggcgcggtcaacgttgccctcggcgtccagatcgagcacgctcgcaggcatgttgtcccagatctcctcggtaacaaacggcatgagcgggtgcatcaggcgaatggaggtgtcgagcacaaagatcaggttgcgctgggcctgcagacggccctcgcccttcaggcgggccttggtgacctcgacgtaccagtcgcagacctcgttccagaagaactgctgcacgccgcgagccatgtcgccaaaggtgtagttctcaataccctcggtgaccatcttgacggccttggccaggcggctgaacatccaggcgtcggccggcgtctccacgacaggctcgccgggcgtgtagccctccatgttcatgagcaggaagcggctggcgttccagatcttggtcacaaagctcttagcctggtcggtacgcgggctgtcgatgagcttcttggtcttcttgtcgatgttcgcgtcgaacttgacgtcctggttgttggtgcacagcgtgagcaggttatagcgcatggcatcggcgccgtacatgccgatgagatccatggggtcaacgccgttgcccttggacttggacatgcggctgccgttcttggccagaatcgtcggatagatgacgacatccttaaacggcacctcgtccaagaaatacagcgagctcatgaccatacgggcgacccacagcgcgatgatgtcgcgcgcggtgaccagcgccgtcgtgggatgatggccctcgagcagctccggcttttgcggccagccctgcgtggcaaaggtccacagctgcgagctaaaccaggtgtccagcacgttctcgtcctggtgcacgtgatggccgccgcacttggggcataaatgttttactcttttgtttaatagtctagcgcgaaagtcccgtaaacggtagagaaatcagcctaaacggtatgtaaacaaactgaacatacaagggaaacaaaaagagggccccgaaggaccctctcttagtagcgttagatatggctgccttagcgagctttgccgccctgcgccccggcgttttcttcgcctagatctcgcacacgctctggcgctcgacaaagtaggtcgacacggccgtcttgcaggtatagctcttggggttgcggatgttgcccaccaggcgacgcaccgcgatctcgcccacctcgtgctttggaacgtgcaccgtggtgagcggcgggttggagaaggcgcccacggaaagatcgtcgaagccaatcatcgagacatcttcgggcacgcgaatgccatgctcactcaacgcacgcatagcacccacggcgagcacgtcgttctcggcaaagaaagccgtcggcagatcgtcgtgcgagaccgtatcgagccaagcacccatgtcgcgataggcgccctcgagcgtggtgcccagggtgacgcgccatgccgaattggcctcaaggcccgcgtcctcaagcgcttggcgatagccacgctcgcggtccttgaaattgcggatgcgaaggtcgcctgccaggtagccgatttgcttgtgacccttctcgataaggtaatcaacggcacgcagcaccgaatcggtgttggcaatgaccacggcgtcgaagtactggcggtcgctccagccatcgagcacgatcaggtgggcggcagcgtcggcgaacagggcgtagtcctcctcgcccagctccgtacccatcagcacgatagcggctgacggatcggcgataaggccctcgacctgcgggcgcacggcgtccaggtcgctaaagtcgagcgagacaaagctcgtgctcatgccgtggcgacgcgcctggcgctccacgccctcgatgaccgcgggatggaaggtgctctcgtccaggatggcgcccgtcttgcgcgcaagcacaaactggatgctcgagctgcgtcgactgctgatagccaagcgactgcgcgcactccaggatgaccttggcggtctcctcgctcacgctgcgcttgcggttgagcgcgttggacacggttgcgggcgaaaagccggtaatgcggctgatctcgcggacgcttgctttagccatcgttccccctagcatcggtcgcggccgagcatcgtggcttgaccgccccgtggctcggcaactaaacgaccgcaaattcaatctaaacagaatatacggagcaattgaggcttttgacagcaaaaacagtccgtatttcaccgcaaccaataagggtgggatgggttagaggcccaggtaggatgtcatgccttcgacggcgagtttggcgccggccacggcatggaccacggtaagcgggccgttgaccacgtcgccggcggcaaagacgcccggcacagtggtcatgccgtgctcatcgaccgaaagcaggccgcgatggtcggtctccaggccgcccgtcgtaagcacgagcttgtccttgggcacctgcgaggccgcgatgacgatggtatcggccgcggcatggtcgagctcttcctcgtagcccaccacgttgttgtcctcgtcaaagatagccgtctcgaacacggggccgttatcgtcgatagcgcagatggccttgccgcacacgatctcggcaccgtcgagctcggtcagctcgacctcgtcgtcaattgccgagatgtggcgtgagcgggcatacacggtaaccttacgagcgcccgagcgcagtgcggtacgggcaacatccatagcgacgttaccggcgccgataaccgccacgttctgtccgatcgccacacttgtggggtcgaccagatagtcgatgccaaacagcacgttgccgcgcgactcaccgggaatccccagcttgcgagcacgccaagtgccggtacccacaaagaccgcgtcataaccgtcgcgcagtagatcgtcgatatgcagtgcgccgccgatagtcgtcgaggggcgcacgcgcacgccgagcgagcacatcacgtggcggtacttttgcaccagcgaacgcggcagtcggaactcggggatgccgtactccagcacgccgccgatctcggggcgctgctcaaacacggtgaccgcgcagcccagctgggccatcttgatggccacggtaataccggcaggacccgagccgaccacggcgacctgtttgccgcacgacggcgcaggcttccactccttgcgatcgaggtaggccgtggagatatagttctcgatgctcgagaaatgcaccggcgtacccttgcggccttgaacgcacgaaccctcgcactggcccgaatggttgcacaccatggagcagaccgcgctcatcgggttgttctggaacagcagctcgcccgcttcctccagacgacgctgcttaaacagatcgatgacctgcggaatgggcgtctgcaccgggcagcccttgatctggcagaacgcctttttacaacccagacaacgatttgcttcctcgacaatgtggatagccacgcgatgcgcccgaaggatatctcctagaccaaagtccccatacggtcgagctgtcatatgccgaccagacaacgtccgtcatcgaagcccatctcggagtatccgacgatttcaccaagatcgatatctcaaaagtcgacctaaccggaaaacaagaggtggagggcgctcagctcaccctatatggacaagacgaaaccggaatagactcctggacctcatccgataagccgcaccgcatcggacatcttgcgcccggcacctacacattgcgcgaaatgatgtccccgcggacctacgaccttgctgaggagataacgtttgaagtgaaggctacgggagaagtccaatctttcgcaatgaaggacgcgccgatcgagatcaaggggcaggtcgacaaacgtcaagaaattgcccagcccaccggggatggcctcttggctaacggcgatggcaaaaaccgcgccgcgacacaagccgatgcggaagggtttttctcctacaccgtcgatgcgcgaaacgagtcgaccacctgggttgatgagttcacgattaccgatgatcttgagtgcgccaaggacggcacggcaagactcgtctcaatcgaaacccctattgccatcggcgacctcaacggtctgtgcaacgtgtggtaccgcacaacgccgctgggctcgtcagacatcgacgagcaggcaaacgcgacgcttaacgatggacatgaaaacccctggcttgagtccgacgaagttaaagagagcctgggcgaggaccgccgtctcgttgattacgaaggctggcaactctggaaaaccgatgtcccgaccacaaaatcaatcacgcttgaggtaaatgagctcgaccttcccgtcgataccatcgtaacgggcattcgccttgagtacggtgcggtagacgccgactttgcaaccaggtgcgacgaagattcttggaagcgcgaagaccttaaaaacgaacatgacgatctcgatgacgccaaggcaacccttggcacagacgcccggggcgcagttgtgcacatgcagacgacatcggcttatacaccccaaactgcgctcatcaacagcgcacgcgtcgatctttgccgcaacggcggcggcgataaacttgagtcacatgacgaggaccgcgtcattcagcgctgcaccctaccgcaggacctaccggcaacaggatcagttcccatcgctgcctgcatcaccgcgctcctgacctcgggtgcggcagccctatggttcgctcgccttaggtcgatcccaaagaagcgctaaggccttgtcgagcgcggcctcatcgggcagctggtcgagctggtcgccggtcaggtcgtgaagggatgcggtcgaaggcgcgtggcgctcgacagaatcctcggtgagggaaagaccttcgattttgtccatgcggtaggaacgttgcccatcaacctcgatgtcccaggcaatcaggtaggtctgatcgccatgcgtcgcgatgcgcaaagggtcgatgaggcgctcgcgcggctgtgcatcgtccatcgaacgataagtaatgcggcaacgaacgccgtcctgaatagcgctgctgagctgctgccagtgcgatccgcggacaacagtgtcgacgacgcgctgattgtagccgagctcttcgggaaggagagcatgtcgaatccgagccgccgcctggggctcgatccccagtgattcaagttcatgattgagcacggcgccttcggcggcactcaggcgcagcggcagcacgcgtccagcatcgccggtaagggatatgtgttcgccgttacgctcgcagataatgcgggcgcccgactcgcgatcagcgagggtcgagacgatatcgaggatctcgtccagcgaagctccggaaatgtcgaagcggctgcaaatctcatttctcgtcagccccgcgcttccggctgcgtagagggcttccatgatgtcgatggcacgcgagagtctctgctcgctggtgagtttacgagcgggcatgctcatgcaccgtcctttcgatgaggtggttccacgccaggttgagtgcatcgggggcaacgggcctcatgccgtccatggcatgggccatgcagaatgaggcggcggcgtcaaagtcgcgcacgtcaacggtccaggtccatccttcttcgctgcgtgcaagatcgcctcgcccgcgcgtgagaccgctgaccatatcggcttgcgactcgcgcgcgaacgagaacgttgccgcaacgggcggtcggtcggcaaaatcgaactcaaagaacaggtaatcgttgagattgaagtctgcgggaatggagtatgcctttgaggggcgccaagcacggacgatgcggtcgcagcggaacgttctgatgttgtcggtggcattgtccagaccgcagaaatacgccgtgccatcgtgttcgaacataccgtagacgcagacggtgcgctctttctgctcgccgcgaccgttctgatacaaaaagcgcagtgcacagcgctcggcaaaggcgctccaaactgcatcgacggtgggagaacggtgaatcggcgcctcgtctgcggcagatgtgtatgccgttcaccctctataaaaaaccgttcgggggcaaggtggaagtatgagctgattttggatataaatatgtcgtcagcaataacgcctcacacggaggggcgctaacgaatcggccctgacaggggcccgaaagaaaggtaggaggccatgacgaaaggtctgcacgtgccttccgagatcggcaagctcaggaaggtctgcctgcaccgtcccggcgacgagctcctcaacctgccgcccgacgagctcgagcgactcctgttcgacgacgtcccgttcctggaggtcgcgcagcaggagcacgacaccttcgcccagatcctgagggaccagggcgtggaggtcctctatctcgagaacctcgtcgccgaggtgttcgaccaggtccccggcgcccgcgccgagttcaccgaccagtacatcgccgaggcaggcatccgcggccagcacatgccgcagatcgtccgcgagaagctggactccatcgaggacaacctcgagttcgtcaagaagaccatggccggcatgaccaaggccgagatcgacatgcccctcacggcgtccacgaccctcgactccctggtcaactccgagtccgagtccgacctgatcatcgacccgatgcccaacctctacttcacccgcgacccgttcgcggtcgtcggcgagggcgtcaacctcaaccgcatgtactcggtcacccgcaaccgcgagaccctgtacggcaagtacgtcttcaagtaccaccccgactacaaggacgtctcgctgtacttccgccgcgactgccagttccacaccgagggcggcgacgtgctgaacatcaacgagaagaccctcgccgtcggcatctcccagcgcacccaggccgccgcgatcgacgtcatggcccagaacatcttctggaactccgactccaaggtcgagcgcatcctggccttcgacatcccggtctcgcgcgccttcatgcacctcgacacggtcttcacccagatcgacgtcgataagttcacgatccaccccgccatcatgggcaccctgcacgtctacgagctgaccgccggcaagaacccgggcgacgtgaacatccgcctgatcgaggacaccctcgagcacgtcctggaggacgccaccggcgtcgaccaggtcaagctgatcccctgcggcggcggcgacccgatcgcggcctcccgcgagcagtggaacgacggctccaacaccctgtgcgtcgagcccggcaagatctgcgtctacgcccgcaacaccgtcaagacggccggaaaagtgtccgccgccggcgacgtcatgcatattgtggtacttcacgcgcgccggaaaatctgcgtgtccggggcggggcttgcggcgcagctcggaatagtccttggagcgcgtgttggtgttctcgataatcgctgcgatgggtgcgcccgtggtgtgtccatcgaccacaccggcgatgatattcgcggcgtcggcctcgcggcgcttggtcgcggtctcgtcgcgaccgggggcgcgacggtccaaaaaggcctgcagctgctcctggtcaacggcaataccagcggggatgccgtcgagcgagcagccgatggcgggggagtgcgactggccgaagatgctcaggtgcaaaacgttgccaaaggtcgaggacatgctattcctcctcgagcgtgaccttgccgcccagcagacggtagtggtcgaagaaatcgggataggatttgttgacagcctcggcgccgtggatcacgacttcgccggtggcacggctcgcggcgatagcggccatcatggcgatacgatggtcgttgtgcgaatcgacctcgccgccggtaaaggcatcgacacccttgatgatgaggtcatcgccggcaatgcgcacctgcgcgcccagcgcggtgagctcgcgggtggtcgtgaccaggcggtcggattccttgatgcgcagacgggcgcaatcgcggataaaggtgcggccctgcgccagcgaggctacggccgagatgacgggcaccaggtcaggaatgtcgtgggcgctcatctcaaagccggcgagtttgtcggactgcacggtggcggcgttggtggagcgtacgatgcgggcgccaaagcgcgaaagcgcggcgagcacgttgcggtcgccctgtgcggagctcagggatacgccctcgacggtgatggggtcggtgccgatggcgccggcacacagccaaaaggcagcgttggaccagtcgccctcgacggctacgctgccgggcgtgcggtacgagccgctgctcacgcggaagttcgtgacctcgggctggccgtccttggccggaatacgctcgacgttgacctcgacgccaaaggccttcatggcctggatcgtcaggttgatgtagggacggctctcaatgaggccggttacctgcacgcaggagggctgggccagcagcggggctgccagcagaaggccggagatatattgcgagctcacgttgcccggcagcacaaaggtgcccgggcgcatgcggccgctcgtcttgagcggaaaagccgccctgcagcagttccaggaaaacgtcggcctgtttgccgacggcatggccttccaggacacctacgcctacatcaaccgcctgcaccacgtgtgggagggcaagccctcggttaccgaagctgagtcgcgtatcggttttgcccgcgcggccaacgtgctcgagcggttccagattgccgttatcggcgaggaccccatcgcgcgcagcgttgcatcgcgcatgtggaatatcgccacggcaacgaccgacaacagcggcatgatgctctgcgattccgaggttccgaccgatgttgacctggtgctcgagatcgcaagcgatgagctgcccgctgacgcagcgccgcgtgccacgattgccctcgccgaatgccacaacctggcccagcgcatccgcaccgccaatgttgccgcccagcaaaagcccgcacgcattcgcatcgaannnnnnnnnnnnnnnnnnnnnnnnnnnnnnnnnnnnnnnnnnnnnnnnnnnnnnnnnnngcgctacaacggcaccttcaccgcaagcgacgcccaaacgctcgccgtacgcctactcgatggcgtttgcgatgccctcgcagattaggtaaactagacgagttgcttttgtgcaacacccacattgggacgtagttcaacggtagaactccggtttttggtgccggctgttgggggttcgaatccctccgtcccagccaaagaaacaaagcgccctgagcccatagcggcccagggcgctttcttgtgggcaagcggagggattcgaacccgccagggtgcggagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccaacgccgccaagcggagggatccgaacccgcaaggatgcggagcgacgcagcggcgcgcggccgccgcaggcagacgcggcgtcggcacttagggacgttcctaaagtgccggctcgggactattttcgaggaccctccgaaggactgtggccaaaaaacggcaaatatgagtactgttaccgttgtagctacattattttcgttaataaaagaagatcttaatgagatttattcgcatcaaggtcttcctttaatgaacacttgaggagatacggcagcttatctgctcgatcgacacgtcaaatcaccttaaatgtggtcaaagttaccgtactacgccattcttgagcccgagaaccgcgagctctatgagcgctatcttgagcgcgttcagaacctgacgaacttccacccggtgggtcgcctggccgagtatcgttactacgatatggacgccgtgaccaattccgccctcgatctttcggatgagattatcgcctgccatgcataaagtcataacattcggtattccctcgtataacgccgccaaggacatggaccattgcatcacctccatcctggagggaagcaattacgccaccgatatcgagattatcgtggtcgacgacggctccaaggacgagacggccgccaaggccgacgagtgggaggcccgttatcccggtatcatccgcgcggtgcaccaggagaatggcggccacggtatcgccgtcctttcgggtctgcgcgaggcgcagggtacgtactacaaggtcgtagactccgacgactggctcgacggcgcggccctttcgaccatgctgtcgatcctgcgtggctttgaggagcgcgaccagcgcgtcgacctgtttatctccaactacgtgtacgagaaggtctatgagggcacgcataccgctatcggctacaagtttgccctgccgcgcaaaaagattttcacctgggatcagatcgggcacttccgtctggaccagaatctgcttatgcacagtctgtgctatcgcacggacgtgctgcgcgagtccaacctgcctatgccgccgcacaccttctacgtggacaacatctacgcctacgtgccgctgccgcgctgcaagaccatgtattacgccgacatcgacctctaccgttacttcattggtcgcgagggccagagcgtcaacgaggctacgatggtcaagcgtctggaccagcagttccgcgttacgcgcattatgatggagtcgttccacctgttccaggacgttgagtcttcgcgcctgcgctcgtacatgatgggctacttcaccatgatgatggcgatctgctcggtgctcaccaagctttccgaggaagaatgcgccgatgagcgcctgaagacgctgtggaatgatctgaaggcctacgacgagcgcatgtatcgtcgcgcccgctacggcgtggtgggcttctttaccaatctgcacggtcgggcgggagacaaaaccacactcggcctataccgtcttgcctcaaagatcttcaaattcaactagcacagaaacgctcgggtaacggggacccctggtccttaacaaacaagaatgccgccgtgacggcgacctccgacaggctcttcctgctcagctactccgaaatcgtcgagaccccatatagcgattggtctgactattcatagattgaacaagagggaacccagtacgaggccttcaagggcaaggtgatgaatagccactcgggcaaccctgccattgccacaggcggcggttcgtgggagcgttcggtgcttccagacaactctgtgcgcttcctctatgtcgacaaccacggcacgccgtcgagcaacatctttgcgtcgagctatggttacgtctgccccgcctggtgtttctagtttcttttggtaaccgcgcgaacgattgtcgtcttgaagcatagttatcgggttgaggagaaaatgggtcatacagtggctcttagagcgcctgccgcgctcctccgccagtacctctgcggcgtcctcgtgtagagcctcatcctgcttggcgtttcgagttcgggaagtacgcggtgggtggataattgactcactcagatgacggcgctgacgggagcggccatggcgatgtgcgagattgcggtcaagttcgatgaggacgaaagagcttcgattcgggataatgcggacgccgcgggcatgtccttttccgagttcgtgagaagggccgcgctcgagaaggctgaggacatggcggacaccgaggcctacaacgaggccttgggcggggtccggcttatagccggatcccgcttttctatggctttcattcgtctgtctaaaggtatgaagcggttgactcgataggaatgcgggcaacgcccgaagcgggcgtcatggctgctctcagagcgcctgactctttcccccgccgctaccgttgccgcagcggcacgttacgggctgatcggttcgctctaacgtacgctcctgcatgcaatatcaatccccatacgaagggagtgtcgcatatgtatgcagcggcgcagaaccttcgggggggggtatctcctagaggtgcccgcctccgagcccaatctatcatcgagtacgtcctgatcatcgcgatcatcggcctggtcatcgtgttcgcgggacccggcgtggcgggggccatccgaaaccagttcaacctggtcggcaacacggtgaacagcgggactggcgctggcaccgagggcggcggtgcatccggcggcggctccacaggcgccgattccgcgaccgtccaggcggccgtcgccaagcgcatccgcactcgcccccgccgcagaagactatcttcgtgcgctgctcgagcagaacgcggcgcaggcagtatcggcggtggcgcggtcgggccaaagcgaagatatgctcgtcgacagcatcaacgaggccctctttgacctcgtgggcgacaccgttattgaatttggcgcggcagggccgcagattatcgaggactacgaagcagacgtgagaggatacctagaccatgagtgataccgcatccgcagcaccccgcgtgcccaagcgcgtcgccgccgtcattctcaactcgctcaagggcggcgtggtcccgcgcatcggccttccctatatcaccgtgggacgcgaagtcgagattcgcgccctgctcaccgatctgagtctcatctccgacggtggcgcgagcttccgctttctggtcggtcgttacggcgccggcaagagctttttgctccagaccatccgcacgcacgccatgggtgagggattcgtcgtcgctgatgccgacctatcccctgagcgccgcctgcagggcggccagggtcagggccttgccacctaccgtgagctcatccgcaacatatcgaccaaaacgcgccccgagggcggcgcgctcaaccttatcctggatcgctgggtcgcctcgtgtgccgacgccgacgagtcgtccgttaatgcccagcttgccccgctcgaggagatggtccacggctttgactttgtccgcatactccgccgttatcgcacggccgtctctgagggcgacgaagagagcatgagccgcgtgaccaaatggattcgcggcgannnnnnnnnnnnnnnnnnnnnnnnnnnnnnnnnnnnnncatcatcagcgacgacgactggtacgactacatcaagctcatcgcgcgctttttggtctgcagcggctataagggcatgctggtgctcatcgacgaactcgtaaacctgtacaagatccccaacgccatcacgcgccagtacaactacgagaagatcctgaccatgtacaacgacacactgcaaggcaaggcacagtacctgggcatgatcatgggcggcacgccaacctccatcgaagaccgtcgacgcggcgtattttcctacgaggctctgcgcagccgcctcgcccagggccgttttgcacacgaggacctcaaagacatgctcgcacccatcattcgcctgcagccgctcacctatgaggagctgctggtgctcattcaaagcccacggcagccgccttgcgcgacaccttctgagcctgcatcagcgccggcaggtgcgtgggcacgccgtcgagcaggccctcgggcgcagcctcgcctgccgccacggccttgtccttggcagctttctcggcaagcttaacctcgtcccagatcttgagtacctcgtcagagttatcggcatccgcatcgccaaacacgtgcgggtgacggcggatgagcttggcgtcgatatcgcgtgccacatcggccagcgtaaactcaccggcgtccgccgcaatctgcgcatgcagtacgacctgcatgagcacgtcgccgagctcctcgcgcagatgcgccacgtcgtccgcctcaatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctcggcattttgctgggccgtgtgctgcgccatggttagtcctcctccatgatcacgtggcggaacgcaccgccctcgtagatgccgtagctgtgcgtgccatccttgggaatgctcacgctgccggggttgaagagccataggcccgggtgcgtctcgcttgcctcgttaaccttgatatgcgtgtggccgtagacgagcgcggagccctcgggcagcgcgggcgcgtggtcgacgctgttgtgcatgccggcgccaaagacgtggccatgcgtcaggaacagctcgcggccggtctcgtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgcgggccgtggtagagcaggtcgcccagcagcacaatgcggtcgggctgctcggactcgatggcggcgaccaggcgctcggtccaatatgccgagccgtggatgtcggaagcgatgaggtatttcatggtggtcctttcgggtggggtggatatgactgggcgcgggatgtcgccggccgcgctattcaaatcgcagtgccgcgctctgggccgcctgcatcacgcgttggagtatggtataaactgctcgcagcccgcaccggccactcacccggcatccgcattctttttgaactgggcaaacgcgctccacaccacgccgttcctgcgctatcgtgggacagctcacgtagattaaggccccatcgcggggcgcccatacatagaaagcgagaacccatggcactgacaggagcacaggtcaagcagcttcgcagcatggcccatcacctcaaccccgccatcatcatcggcaagtccgnnnnnnnnnnnnnnnnnnnnnnnnnnnnnnnnnnnnnnnnnnnnnnnacggtcgcctacctggagaagcatgagctcgttaagtgctccgtgctcgacggctccagcctttccgcccgcgaggccgccgaggagctcgccgagcgctgccacgccgaggtcgtccaggtcatcggccgcaagttctcgctgtatcgcgagtcctcgcgcaaggacatcgaaaagatcaagctcgtctaagagccaacgatccggcaagccagcatacagcaagcctgcgggcgtccgagcaattcggacgcccgttttttatcgctcgaccagcacgcggttaagcctaccctccaccaagcgctcgtacagacgccgcgtttcgggctcgggcacgccattgacctgctccctcaggtggtgcatatgcccgctgtacagctcgacaatatcgcgccgccgccccgccgcgccgtagacgcgcatagcgcaacgcaccatgtcctcgcgcgctgtctcttggcgcagccccgactccaccagccataccgccgactgcaggtcgttttcttctagggcggcattcgctccccgaatcatgcagtcgatatacttcgattccataatgcgccgcatgcgcaaaaagtaggtgggattgcagccattgggaacatacaacggaccggcgtagagctgctcgatcttgaggcacagctcgaccagatggggtccgcgcgcacccgtgcgatttcccaacacctcacgactaatctgatcgaatagcctcacatcagtcttaacatagtcaccgttaagcccaatgcactcattttggatcagcacacacgatttgccgtccggcgtcggccccaaggccgagcgcaggcgtgatatcgtcgaatacaggttgttacgggcgctattgaactctgcgtggggccatagctccatggccagcgtctcgcggtcgaccagcgcatccatttgcgcttgagagagacccgcaatgtcagaccccggactcttaatgacgttggcagaatcggtcagcaccggctttcgcaggcgcaagtcgcacggctccaagcccagcgccgccacggacgccgaaacggtatcgccgagccacgatgcaatggagcccagcgcgccactgctccctcccaggccatcgatcatctcatccataagctcgtcggccgagccctgaatgtctccgtatcccacaagcagccgtccccaaacatccatgacgccatcgagtacgccggcaacgccacccgaacgctcctccagcgtcgagaaaaaccgcgagagaacgttgttctgcgccgtcgcgtcatcgggcgccagcaccgcagcagagatcgcgccgcgatcgccaagcctgactgtcgtgttaaacgaagagttgagctcatcggggctcgagatggcacccgaaaccgcaaaggcagccacgccgttgcgaccgggcggggcgatacgcggacgctcgcccgaaagcgctttaatggcctggtcaaacgcgttgcccgcacggtcagcctcgtcctcggtctggcgcatgagctcgagctctttgttgcggcattcgacgtagtcttccagagcgtctttaaacttgtcaaagtgatactcgaagccgttttcgatagaggttgaaggcgccgcaacagcaccaagcgacgaaacgccaaaatggcatttgctgcatttatcctgtccatcgtaatcggcaaccgaagcaaatccgctcggcgtccctttcttatagttagggcaggtcgtcccgtaatgcagatacgccttgtcatcgttcacgctcgtcggccacaccgcatcggtatagagttccgtcgcccgaacctcatcagagttgcgcggcagcagcggaataaaggaggaaaccctgtctccgttctcggttatatgtgcccgatcgacctccgcgctcgcatagatataaaacgccttacgcgccgcagactctgccttcatctcgacactcgagccgtggggcttctcatttgtcagacgccaatggtagtagtccttcgcgcgatcaagggcaacttggggctcccacgtaacgctcgatgagtaatgcggattttgaacaccggagagatccgttaggcttttcgcacgcccccacatgcaagaacagctgccgaccgagcccttgtcagacccaccactgctccgacgaggacgatattctggagcacaagcgcggctgcctggtggccaagccgggggagaccgtcacccgcggctttgagatcgagatcctttaacgagctatcgtatgtttggggcgggttatgccgccccggaacaggagttcaacatgattctgaccgttaccatgaacccgtcgattgatacgcgctatcagctcgacaagctgatcatcgacgatgttaaccgtgtgacgcccgaaaagaccgctggcggcaagggcctcaacgtgagccgcgtgctgctgcagctgggcgatgacgtgctcgcgaccggcctgctcggcggccacatgggtgcctatatggctgagcttatggatgccgacggcgtcaagaacgactttgtgcccatcgccggtgagacgcgcatttgcctgaatatcctgcacgagggcaatcagaccgagctgttggagagcggcccgcagatcgccccggccgagctcgaggcctttacggccaagtttgccgagcttgcagcgaaggcagacgttgtgacgctttcgggctcgctgccgcgcggcgtcgatgccggctactatgccgagctcgtcaagatcgccgaggaggcgggcgccaaggtgctgcttgacacctcgggtgcatcgctggaggccgcgctggagtctgacgctaagcctgagctcgtaaagcccaacctgaccgagattaacggcctgctgggtacgtcctttacgaccgatgatgtcgatgccctgcgcgaggcgcttgccgcagatgaccgctttgccggtattccctgggttgtcgtttcgatgggcgctgccggttcggtgggcttccatgagggccgcgcgttccgcgccaagacgcccgcgattgcggctgtgaacgcaacgggttccggtgactcgaccatcgccggctttgcgcatgccattgcggctggtgccgacgacgtcacggtgctcaagaccgccaatacctgcggcaagctcaacgccatggatcccaagaccggccacctggtcatggatcgctgggacgaggtctacaacagcgttgaggtgaccgaactttagagttacggcgcgccgaacaaaacgagcgtggataatctcccactttgggctcgcaaaggggccccaagtgggagattttccactctcatgggaggtagctaatttgggacggggccattttgatcaaggagcgtacgtacctcaccggctacaagcacctctttggtaacgctgccggcttcctgatggctgcactcgtcggcttcggctttggtactttcggcgagaccaacccgttcagctacttcatcatcgctacgattaacgcttcggtcatggcaatctcgctgctctgcgtgtacctgtccacttgggagcacacccacgaggaggttgcccaggagaagatcgagagcgtcggcgagggcatcaagaagttcttcatcgacgttgtttccaccttccgcaacaagtccttccgtaaggttctgtacgcacaggtctccacgaagctcgctgctgcctgctggtctgcctgcctgtccttcttcatcgtctactgcctgcagattcctaagtcctacgagtccgtgannnnnnnnnnnnnngtcgctatcgtctgcaccgctatctgggttgccctcatggccaagaagggcttccacaagtcttggtacctggccaacgtcggttgcgctgcgtgcatcattgcgtacaactacttcgcctttggtcagatcaacggcacctctacggtcgccattgccatgatcgcctaccccatcatcttcgccatctggaagttcttctacgttggcttccagtatctgcccgatgttctgctcaactacatccccgatgtcgatgagctcatcaccctgcgtcgtcgcgagggaatctacagctccgctcagcagctctgccagcagatcgcccaggctgtcgccgtcaacgcatgggctatcgtcctcgctgcctccggcttcattcagaccgccggcaacagcgacgctgtgacccagcccgctaccgtgcctctgtacatctgcggctacatgctcatcggctgcgccggcttcttcctgctcgcggctgtccttgcccgcggcatcaagatcgacaaggagcagtgcgacatcctctgcgacgagatcaagcgcgtcaaggagggcggcaagatggccgacgtccagcccgaggtcaaggcgctctgcgaggagctctccggcttcaagtatgaggactgcttcgctcacaataacgttggcttccaggacggcagcgtgacgcccgccgagtaaggcaagcgcatcgtccacatcacagggccgtgccaccggatatccgccggcaggtacggcccttttttacaacagcgtacaattaacttttagatctggtatggccggtcatccttatggcactgtgcagcaaaaccaggtcgcgcaacaccgccatcggcatcacgatcgcattcgcgcttgcgtcgacggcagccatggtcctcatgtttaatcccaccgccgacacatcgcgcgtctactacggaaccgacgcccgtgccgccgagcttctatgcggagccttagccgccatcgccgcgccgcgtctgcgcgagatgctgagcggtgacatccatacccccggcgccaacaagggcatctcaaaggtcaacgcgatttctatcgcgtggctcgttgccgttatagccggcgcactcatgctgaccggagagagcgcctggctctaccgcggcggctttttgctgtttgccctcgccaccggactcctcatcatctgcgtgcagaatacggagtgcatcgtgcgtcgtctgttgtcggtcaagccgctcgtctggctgggccagcgctcgttctcggtttatctggtgcactatcccctactgcttcttatgaaccccgcaacccgcactacccgcatcgcctggtgggagcaggtattacagcttgtactgattcttgcggtagccgaggttttctatcgcctcgtcgaacgcccttggtcccacaagccgacccaacaggacagcacggcaagaaaacacgtcctcgcgcccgccatggtgctccccgcgcttggcgccgcatgcgtcgccgcacttgccttcgcgccgcttgactgggcaggcatcgccaccgcccgcgccgagcagctccgtcccgagcttgcccagaacgcgacctcgtcccaggacaacggagccaacgacaagggcgccgagcctgcatccggtaaagattcccagcccagcgacaccgcatccgatgacgcaaccaagcaaaaacccaaagagggacctatcgccgaaaaggtccccaagaaccttgactggaagagctttacctacgacgaggcgaccgggacctgcgacgcccgcgtgctcatgatcggcgactcggtcaccgcaggtgcccaatctggcattcaggcagcgcttcccaacgcctacatcgacggcgtggtgagccgccagttctacaccttccaggacgtctatgcacaggacagtgccaactacgatccaagcgtggtcatctgcgcgcttggcaccaacggcctcatccgcgacccccagcaggtacaggctttccctacacgacgctcttccgatctgtatggtgtggaataccgcgatgccagcgaccgctaccaagcgcagcgcttcgatggaggtgtttctgcttgttttgctgcccatcagactattttccagcgcgtgcgttgtatgaaccaaagtgcgatgtgatcatttttagagtttgcttgggccccttgttccatacgttatacaggccctcgcccacgaggtccttggcgtatgcgcagtagctgattttagggttggcgatgcccatatactcggcatagagctttttggccgcaggggtaatgcgaggattggcaaataccagctcttgcggcatgcgttcgaacatcctgtggatcgcccgctcgatttcggggtggccatcaattccggtgtgctcaatcatgatgcccatataggcgaagccacgtgtgatttggggtgtccaaacggcggggtcggtgacgttgagccgcnnnnnnnnnnnnnnntatcgaccatgtcgttccagcgattaaacggcatcaaggggtcacgcttggccagagctgccgccttttcgggtgtttcctcgcggtagcagtaatacggcttgggccagtaagcgatggcctttgcctggcatagcgtttcgacgaggaatggattatcggcccaacctgcaccggggatttccttaaaccagatattgttttgcatcaggaagtcgcgacgatagattgccgaccaaatggacggatgatgggccagcagatgtggagcgtcgtgaatggtgaacggttgccgagacggtttgatgcgaccacgatatgcgcaatgtagtttgacctcttggggggtatcggggttgcgaatgatccaatacggggtctcaataatatcgagcttgttcggaccgccaaattcgcgcttggcaaaggcaaacatgtcggagtacattccgggctcgatccagtcatcgggctcgaggatggcaatccagtcgcccattgcctcgcgaatgcccagattgcaggttgcgccgtaaccctggtttgccttatcgatcactcgaacgcgtgagtcgcgcgcagcgaaatcttgcataatggcgagcgagttgtcggtggatccgtcgttgatggcgaggatttccagttcgattttgttttcgtttaataggctgcctatagcctgagaaagatacggctcggcattgtaagtaggcatcctcgagaccatgtgggtctggaacgactacctgctgccttaccttacgcttgactccaccaagtacaagaccattcctatcttgatccagtacttccgcggcggctatggccatgttgagctcggccccatgatggcctgcatcatgatggtcgttatccccatcgtcatcatgtacatcttctgccagaagtacatcattgacggtgtggtggcaggtgccgtcaagggctgatgccgtaactgttttgcaagtttctgcggcgcccctcagcgtggcgccgcgtatcgaaaggtaaagacatggccgagatcgttctcaaacatgttcagaaggtgtatcccaacaacgagtccaaaaagaagggcttctttggcaaaaagaagaccgaggagaagaagcacaacctcaaggttaccgaggacggcgtgcttgcggtagaggactttaaccttaccgtgcacgaccaggagttcatcgtcctcgtcggcccctctggctgcggtaagtccacgacgatgcgcatggttgccggcctggaggacatcacctcgggtgacgtgctcatcgacggcaagcgcgtcaacgacgtcgctcccaaggatcgcgacatcgccatggtgttccagagctacgccctgtaccccaacatgacggtgtacgagaacatggcgtttacgctcgagctcaagaaggtccccaaagacgagatcgatcgcaaggttcgctccgctgccgagatcctgggtattannnnnnnnnngtacctcgaccgtaagcccaaggcgctctccggcggtcagcgccagcgtgtcgccatcggccgcgccatcgtgcgtgaccccaaggtcttcctgatggacgagccgctgtccaacctggacgccaagctccgtaaccagatgcgtgccgagctcatcaagctgcgtcacgagatcaagggtaccttcatttacgttacccacgaccagaccgaggccatgaccctcggcgaccgcatcgtggtcatgaaggatggcgtcgtccagcagatcgccacgccgcaggaggtcttcaaccaccccgcgaacatcttcgtcgccggctttatcggcgtgccgcagatgaacttcttcgatgcccagctggtgcgttcgggcaacggctttaccgtcaagaccgaggacatgaacgtggcgctcgcccccgagacctgcgctcaaggcatcccatggcgttgcctcgacgtcggttatcgacgccgctgcgggtgctaaggacatcgcgttgtattgatatcgcgcgtgaggaccgggcgcagtctacggtcgaggccgcttttttgctgccgacgtttctgacgctcatccttctcgcactgcaaccggtgtgcctgctttatacgcgcgcggtcatggagtctgccgccgccgagaccgcgcggctcatgaccacgacgacggcggaggacgacgatcttaaggagttcacccgccgccgacttgccgcagtgcccaacgtttcgatctttcatgccggcgggccgttgtcgtgggatatcgagcttggccgggccggtgcgggtggcgtctcgtccgtgtccgtttccggcgaggtcaagccgttgcctgtgatcggtgcgtttgcgcaggctatgggtggtaccgccgagggcggctacgttgagctcaaggtcgatgtctcgtatcaatcgcgtcccgaatggctggagggagattatgattcgtggattgctgcatgggattaggcgctgcctgttgcgggtgacgcaagggtttgcggcccgccgtcgaccaggcgctctccgcaaacgaggcggctttatgggtcgagccggtatcgacctgtttatcgaagacggtgcctacaccacgctctcctctgcggtggtcatcttggtggtgctcacgctgctgttttcgtcgaccgcggcgatatggagcatgtcgcgtgccggggatacccaggtggcggctgatagcggcgcgctggcgggtgccaacgtagtgtcgtcctatcacacggctgccacggtggttgatgcgagcatcttgagtctggggctggcggggtttgccacgatcgggacgggcctggtcgccatcctcatcccgggtaccgagccggttgccggcaatatggtcgacaccgggattgagatcattaaaacgcgcaacaagtttgccaaaagcgcatcggaaggcttacagaaaatcgagacggctctgccgtatctgatcgccgcgcgtgccacgcaggcggtgtcggcgcaggataccgatagtgtgacctataccggtacggcgcttgccgtgcccaggacatccgagtctgacttcgctgcgctcgaggggtccgagatctcgaccgatgccattaaagacacatcagatgatttagagtgttaaagccgctggtgttggcaatcaggatgttaaggcccaggccgtagtggagcagattcatgatgccgaagtcgatgacggtggcaatgacgccgacgacgccaaacttcatgatctgcgcaaggagcttttgcatggtacctgccttaagctggcgccgaagcgccgcggggatgacaaacccagcaagtttagccaatccccgcgggcggggctaggcgcgctcctcgatagcaccgtttctatatgcatcgagcagctggcgcaggtcctggatctggccacggattttggcgccggaatcggtgtcgcttaccatgcggcgacggtcggcctggtcaaaacggttggtctcgctctcgatgtccacgnnnnnnnnnnnnnnnnnnnnnaagccgccatcgatgaccagcagttttccgtcggcgcggatgggttgttcgcccttggtggtcttgacgggggtgtggccgttgatgatgtgaccggtcggcgaacatgccatggggacgacgccgaactcgtgcatgatgtcatcgcagaccgagggcgacgtggtgagcgtgtagtacggatccatcggctcgacccaggtgctcttgtcggcgatataggcgcgctcaaaggtgcgcaccaggcgtccgctggcgggcgagttaaagccgatccacaggtaccacatccagtcgagggcgtcacggtcgcccacgcgccaggcgcggcgggcgatgtggtcgcaaaaatcgaaannnnnnnnnntcgcggccggcgtgccaggtgcccaggcagttcatgctgctaaaggtgccgtcctcgttgagcggcacgcagccgtggaacagcagattgccgttggcgaccttgtacatcgagccgtgggaatagaggaaatcgatatggcgatgcaggtgatcggcggtgacaaactcggacacgagcttgtcgatgatgtgctgctcctgagacgtgagcgtataggggtccgccgggtcgacggtggggaagtcgttggtcgtgagcggccacacgctgccgtcggcgagcgtgaccgtgccggtgccgtgatcgatcttgtcgagtaacagacggtcggtcatgtcgaactcgggatggcgctggataatctggccctcgagcttaaagagcaggacgttgatggccttgatcagcggggtgatggactcaccggcgattgggcgcgttcgaggagctgtcgcgcatgtttgcctcggccgtgggcaagcctaagcgcgcgatggtggtttggagcgatctcgcatccgagcgttttgacgaagtcgttgagcatgcactggtcgatgccgggtttgctgtgtcgcagctcatcctcgaggtttcgcctgccggtgctacgcttgccgaagccgatgccgtctttggtgccctgtcggctaacggcattaccagcgatgatcttattgtcgcggtcggtgacgcggcgacctgctcggtcgtttgctggtgtgccaaccagtggtgcggtcgcaccgagtgcgccttgctgccgacgacattcgatgccatgctcacggtcgcgacgactatggagccgctcgtggcttccgccgcgaatgcgcttcccgccattgcgttccgtcccgagccgggcttggtcgtatgtgatctcgacctcgctcgcgaggccgaccccgaggacctcaagcgcggctatgccgtactcgtgggcaccatgctttcgagcagcaagtcgcgttggaatcagtttaccgagactgtccccgagatcctcgcgggcgaggaggtcgcgctcgtcaatgccgtgcagtggtcgcagaccgcgcgcaaggacgtgctcatggccacgaatccgagtgcgcgccatgcactcgattttggcaagacaggggagcgcaccctgcgtgcctgcctgggcgaagccactgcggacgttcccgcctatcagctcctttccgagggcatgcgatttgaggcgcgtgtcgcccacgatgcctgcgacttcgatatcgattacgtctttgaggtcgatgattgcctggaggactttggtatcgaggagctcgccttcgaccttgagcccgccgcctttattgcggagttccgcaaacagcagtttgcgcgctcgaaccgtagcatgttgccgctgcccgcggcgcttggcgccatccgtctgacgaacgtcgaggacgaggtccttgagcgtcacgcccaggcctacttggcttctcgcaaagaacttctctaagatttattgacatccatcgtctttcgtatcatgttgaggggcgggtttccaatcggttacggatcgcgcgtgattccgtggcccggttgaggcccgtcccgtctttattgagggacgtgcccgatgtctatttagaagtgcaacacccttgttggtcctgtaattctaacagttcgtcggcgaacgcctcggcgggcgtgcggtagccgagcacgcgcatggggcggttgttgatctcgtcgacgatctccctgacctcctttgccatgtccatccggatctcgcagcgtttgggcagataccggcggatcatgccgttgcggttctcgttgcttccccgctgccagctggagtacgggtcggcgaagtacgtggccatgcccagcccgtcgcgcagcctttcgtggtgggcgaactcggtgccgttgtcgtgcgtgacgctgacgcgcgcgccggccggcagcggcgagaacatgtccagctgcgccccgacgctctcgccggcggtcttgtccggaacgatgcgggccatgaggaacctggtcctcctctccacctcggtgtgcaggttgcatcccactccgatgacgctgtcggcctcccaatggccgaacgcgctcctgccgtcggcctccggcgggcgttcggagatgggcactcggccggggatcgggaagcgcgacgtcctcctgccgccgtgcctgcggcgccgcctgtgccctcgcggcaggcaccgcgcccagcgttcccgaagcggcctgctggagtagacccatcggtagatggtctccgggcacacgcgcatgagcgcatcgtccggccacaggacgcgcagcctgccgctgatgagcagcggcgaccagccgcggcccagccattcggtcacctgcgcccacaggcggtcgtgcgacagccggtagggctttcgtggcttggatctcctgcggtcggccttgcgctgcgcgggcccggcgatgtagtagcggccggtccatggccccgccttcagtcttttcggccggtacgggcggtacgactcgttctcgttggacgggaaccatgtgttgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacgggtgtaagaaccggtcatggcgaagcccttgtcgttggcgcgcgggatgagcagcgtcagcgcgttgggatcatcggcggactcgacggcaagcttgccctcgggagcgcaggtgatgttgaggaacttgacgttgtggacgagctccttggcaacggcgacggcggcaaggctctcggggctgttgccggaacgggcgaaggaaaccacgagcgtgggatcctcggcgcgcaggaagtcgcgcggagcgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagatgttgagcgtatcacgccaaagctcgggctgctgtgcaatctcggccgtggtgatctgggcgccgagctcggtgagctcctcgacactcttctcgaacatttctaatacctctctctagaagtaatcctctgacgtgcaattatacacttcggttggttatctggtagtaaccagttaaatgcaaagaatcatcacatgaaaacactggaggcgctaaacgttgcgctggtgataaaccttgtatttaaactgatcggcacgagcaacnnnnnnnnnnttgcttttgccgaacggtcggtcacaaaggtgccgcgaccgtgctgccgaatcaccagtcccaaacgctccaactcctgcagagccagacgcactgtggtgcgcgagagaccatagcgctccgaaagttcgcgctcggaaggaatcatgtcaccggcatgatattcttgttcaatcacatcgtaaagcggcttgcgctccagaagcggtcgcttgagggataagaattgacgaaccggtagatagctgcgttcgaccatcatgggcatgttgtcggcagaacgaaggcgcttgagcttaaagatacggtcgccgatgcggcatcccatatgctcggccagattcttatcggcctccatctcgcaaaactcgagaatcgtagtctctggatcgcgacccatcgcacgcatctgctcggtaaagctgtaggactgcgggcaagaacatcgtcctgctcttccagaagacctccactcgtacccgctgcgccttcgaggtcggcggcatggatctgggcatgggcgttacctacctcgatccgggttcgtcgcagatgggcaagaaggagtccatcgaggacaccgcccgcgttctcggccgcatgtatgacggcatcgagttccgcggctttgcccaggacgacgtcgaggagctcgctgccaagtccggcgtgcccgtctggaacggcctgaccaccgagtggcaccccacccagatgctcgccgacatcctgaccgtccaggagaacttcaactacgacatcaagggcaagaccctcgtcttcatgggcgactgcaagaacaacgtcgctcgctccctcatggtcgtttgctccaagctcggcatgaacttcgtggcctgcggccccgaggagtgcatgcccgctgacgacgtcatcgaggcctgcaagcccatcgccgaggccaacggctgcaccatcaagctgaccaccgacgtcaaggacggcgtcaccggcgctgacgttctctacaccgacgtgtgggtctctatgggcgagcccgacgaggtctgggccgagcgcatcgctcagctcaccccgtatcgtgtcacctccgaggtcatggctatggccaacccgggtgccatcttcctgcactgcctgcccagcttccacgacaccaacaccaccattggcgccgagaagtgcgagcagttcggcatcagcgagcaggaggtcaccgacgaggtcttcgagagccccgcttccaaggtcttcgacgaggccgagaaccgcatgcacaccatcaaggctgtcatgtacgccacgctcaagtaagagcatctagcatctcgctcggggtgtattgctgcacgccccgagcggttttatctggtaaatatctcgcaccaagcggtatgcacggcacggaagagtcgctttgcgcgagatcagttaaatgatttatgaaggggggatgagaaccatgactgagaccgctaagaaaaagcgcggtatgccttcatcgttcaccattcttcttgctctgctggctattgtcgcagtgattaccgttatcgtctccggcacgtccggcggcgaggttactgcagcccgtctgagcgatttctggccaggataatcttgtcgccctcgcgcacgcggcgcacgttcagcagcgcgtcgtcgtcacgcaggttgatagcgatcaggccgtcgcgacggctgcggtcatatgcgctcatcacggtcttcttgaccatgccgctcttggtggcaaacatcaggtactcgtcggcagggaactcgcggcagctgatgacgctcgcgatcttctcgccctcctcgaagggcagcaggttgacgattgcggtaccgcgcgcctggcgcgtacccaccggcagctcgtgcaccttcaggcgatagaccttacccttgctcgagaagaacagcacgtactcgtgcgtggacgcgatgaacatctcgtcgatgacgtcgtcctctttgaggttgacgcccgacacgcccttgccgccgcgcttctgggcgcggtaggcggccaccgggatgcgcttgacatagccggtgtgggtgatggtcacgaccatgtcctcatcggcaatgaggtcctcgacgtccaggtccttctcgacatggctgatctcggtgcggcgcttatcgccgaacttcttggagatctcgcgcatctcttccttaatgacgcccaggatcttctcctcgtgcgccagcaggtcctcgtagtaggcgatggcgcggcgcaggccgtccagctcttcctggatcttgtcgcgctccaggccggtcaggcggcgcggcttcatctcgaggatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgcagcatctcgcgcaggctcaggcatttgggaacgccgttgacaagcgccaggttgttggcgccaaaggtcgtctgcagcgaggtgtacttgtacaggttgttgagcacgacctgcgggatgacgcccttcttgagttcgatgaccagacggatacccttctggttggactcatcgcgcatatccgagataccctcgatgcgcttgtcgttgacgagctgtgcgatcttctcctgcagggtgcccttgttgagccacgctgcttacgagaccctctccaacgcggttgacgctaagggccgcaagatgaaggtctacaagctctgcatgcccgtgaacccgctgttcatggaccaggcctcctgcgacaccatcgacgccgacgagaacgccgagccgcgcgtccccgacgagccgctgatcgcctcttacatgaactacctggtcaccaaccacggcgttatcgtcccgcagtacggcgacgagaacgaccagctggccgttgacacgctccagaagatctacgacgaggtctggggcgagggcgtctacaagtgcgtcggcgttcagtccgagcaggtcgtcttcggcggcggcaacatccactgcatcacgcagcaggagccgtccgcttaatcgtctgtcttcccgaggcacggcaccttgcccttcaatcgtcgggcatgacccttaaggtctatgccctcctctttcagggcaatctgccgcacctcgggcggtcggtctatttgtttcgtttgatagtcgtatttaggaggtcgctttatggccgacaatcgcaagcgtgcaccgcgtggaggcaagcaggctgcttctggctcgcgcccgattcgccgcaatgaccgcgctgccgcttccaagggccagcgcgagcgctcccaagcccaggctgcgcgtccgcagcgcgatcgcaaccgcgacgctgtccaggctcccaagggcgagtttatcgaaggtcgtcgtgctgccgccgaggccctgcgcaccggctttcccgtcaagtgcgcgctcatcgccgagggcggggagcgcgatgctgctttgtctcgtctggtcgatgacctcaacgccgcgggtgtccgcattaagtatgtgccgcgcgcgcagctcgatgcgctgtcgagccatggcgctcaccagggcattgcgctcgaggtgggtaatttcccctatgctgatgtcgccgatatcctcaatcgcgcgggtgacggaccggcgctcgtcgtcgtgctcgaccatgtgaccgacgatggcaactttggtgcgatcgtgcgctccgccgaggtcgtgggcgcggcgggcgtcatcattgcaaacaagcgcgccgccggtgtgaccgtgggcagctacaaaacctctgctggtgccgtcagcaaaatgttggggtttcccaggtgcccgaggttgccgtgaaagaggagcgccgcgtactttggtacgcaagcgacggtttgaggggcaaggtcgggtgcctggggaagccctacagttcaagttcgtttagacggaggatcgccacaatatagatcttgagcgcttgtttgagctggtcctcgttggcgcactcgttggggccgtgcatctggccgccccacgcgggcagctccaggccggtctcctcgggaccaaacgacacggcgcgggcaaagttgcgcgcgtacgtgccgccgcccatggcgaagggctcggcgtgcttgcccgtaaactcgttataggtgtcgatgagcgccttcacggccggatcgtcggcggacaccgagaacggcaccttagcacggcccaagcgacacgtcacgccaaaacgcccgacgagcggctccagctgctcgcagatggtgtcggcgctggtgctatcggggaagcgcacgtcaataacctgctcaatatggccatccgccacgcggatgacgccgggattgcaggtgagcgggccaaacgccgcgctcgtcgcatcaatccctaggccgcggccataggcatccgcgtgcacgaaggccaggaacttgacaaactcgtgctcggcaggcgtcagcaggcgctcgtcacgcgcaccaaatgcgtcctcgacctcgcgcaggtacgccacgatcaggccgacggcattgatcgtaccctcgggcatcgaggcgtggccgccgataccgtgggcgaaaatctgtgcattgccattctcgagcgccgtgatctccagacggtcggcgttctcgaccggcgccggcagctcctcggcggcaatcgcaagctcacaaatggactgcgacggaatggcattgctcgcctcggcaccgctccaggacacaatgcgcccgccgtcgatcttggggctcacaaacgtcgccccaaactggcccttctcggcattgcagaccgggaactcggcatcgggcgtaaacaaaaagtcggggttggggtagttctccagataatggtgaacgtcggacatgcccacttcctcgtcgcagcccagcagcgcgcggaaggtgtagcgcggggtaatgccgtgcttgattcgccatctagcgttaaacgaagttgtgaggcgttggaacaatgttctgttgtttcatcgttttcatgccgttgtttcacggctcataagatagcagctcaagatgagattgcgccggggaagcaccgatttaccgtgaacggtaggaaatcagcggtgaaacgctatttcaccgcttatgaaacattttgctttattttcacctctcttgacctaagatacaaagcaaactagggccaaggagtaaccatggattgcgtctggcgctcggcatatccatcagcagggcctccggcgaggaaaaggccacgggcggcaaggttactctggacgacgtcgagggctccattaagtacgtcctgtctcacaaggtcaaggagctctcccaaaccgcctcgctcattgactccgatgacttttcggcagtcgtcaatctgctccacaacgccaacctcgtcctgattgcgggcgtcggcaactcgattagcatgggcgtaaacgcggcgttcaagctctcacaggttggagtcagggcgttttgccccagcaccaccgatgccatggtctccgccgcaaccaacctcaaggagaatgacatcctgctcgtcatttcgacgtccggatactcgaagcgcctcgtcaatcgcgaagcgtgccacgtatatcatccgagccatctcgcgagatcaggccatcaccggaaccgaggtcgccttctcgcacagctcgatcaacttcgtcatcgagctgctgttcctcttcctgacctcttgctgggatgacccggtagagcttaacaggatcatctcgaagaatctcttgggagacaggcaatacagctaggacgacgcacaccggcgcaccgacgcccagaccgaaacgggaggaccccttgataaagctcatcctcgcagacatggacgggaccctgctgccgtttggctcaagggtcgtatcggagcgcacgcacagcgcaattctttcggcgcttgatgcgggcatcgcgttcggccccgcaagcggccgcgactacgccgacctggccgatgcctttgacggcgacgcgcgctgtttctcgaccggcatcatggccaacggaaagaaggtcttctccagcggcgaactcgtacaccgccgacaccgtcgccaagttcgcgcaaaccgtcgccaccggcgagctcgcctgcaccgtcatgaccatgaccccgcccgatcctttcggctacggccgcatcaagctgggcgccgacggtcagatcgagcgcatcatcgagcagaaggactgcacgcccgagcaggccgccacgctgctggagtgcaacgccggctgctacgcctttgacggcgcgcagctcgccgcccacattaacgagatcggcaacgacaacgcgcaatccgagtactacctgcccgacatgctcgagatcctcaaaggccacggccaggctgtctccatcttccactgcgacgactaccgcgacggcctgggcgtcaacagccgcatccagctcgcacagctcaccgccatcgcgcgcgaccgtatcaacgagcactggatggccgagggcgttaccttcatcgaccccacgcaggcctggatcggccccgatgccgttatcggccgcgataccgtcgtgtggccgcagacgcacctgatcggccacgtcaccgtgggcgaggagtgccagctcggtcccaacagccgcctcaccgacaccaccgtcggcagcggctgcaccatcgatgagaccatcgccatcgaggccgtcatcgagaacggcgtcgactgcggcccgcgcgcctacctgcgcccgggcacccacatgctcgacggctccaaggccggcacgcacgtggagatcaagaagtccacgatcggcgagggctccaaggtgccgcacctgtcctacatcggcgacaccaccatgggctccggcgtcaacgtgggcgcgggctccatcacctgcaactacgatggcgtgcacaagcacaagaccgtcatcggcaaggacgccttcattggctccgacaccatgatggtcgcgcccgctcagatcggcgacggtgcactcgtggccgccggctccgtcatcaccgagccggtcccggcagacgcgctcggactgggccgcgcccgtcaggtaaatattgagggctgggccgccgattatcgccgccgtctgcacgaggacgacgaggtataacgttttaccaagcatctaaggagctgttcccatggggacggctcctttttctatgctcaagcgtgccctgttgtcccaaatcactaaaaatgccgtgcagatagccccaatgtggcaatatggtgtctgcataatgcaacgatgcaacctccgaaagaatgcgagcgcccgtgtccagtccgtttaccagctttttagcccagcacttcgaccagatcaacgactatctggccacgttctttgacggacaggcgacctctgccgatatcgagcgctacctgtacgcgccgctctcggcgtttacggccaacgccggcaagcgccaccgcccgctcatttgtatgctcgccgccaccgctgtgggcggtagctttgaaagcgcccgcagcgccgcagctgccatcgagcatttccagtcgggtgcactcatccacgatgacatcgccgacaacgggcagctgcgccgtggcaaaccctgcatgcatcttaccgagggcacggggcttgccatcaactgcggcgatctggcgctcaccatggtcaccaagacggttctcgacgaccccacgcttgcgcccgacgttaagctgcgcgtgctccatgagctcaccgagatgattgtccgcaccattgagggtcaggcactcgacctgggctgggttcgcgacgggcgctttgacatctcggttgacgactatctggacatggcgacgcacaagaccgcgttttacagcggggccacgccgcttgccgccggagccattatcggtggcggcagcgaggagcaggtcgaggcgttgcgcatttttggcctgcacaccggccttgccttccaaatccaagacgacctgctcaaccttgtcggtaccaaggaagccgccaacaaggacttccgcaccgacatcaccgagggcaagcgtacgctcgtcgccgtgcacgccctgtccgataaacgccaccacgatgaggtcgaggcaatcctctcctcgggcaccgaagaccccgcgcagctcgcacgagccgtggagatcttccaggggagtggctcgattgactacgcgcacgcctacgccttggacctgaccgctaaggctaaggccgccatcgaggatgtgcagctcgacccgcatgcgcgcgagttgttcctctctatggcagatttctttgtggagcgccttaattggaggctgacgccgaggaggcgcgccgcctggccgaggccatcctggaggttaagcaggaggttcacttttgcagccgctgctttaactacgccacggccgacgagtgctccatctgccaggattcgatgcgcgacaccactcgcatttgcgtggtgggcgagccgcgcgacgtccaggcaatcgagcgcacgggcagctaccatggcctgtaccatgtgctgggcggcgtgatcagtcccatggacaagattggccccgagcagctgcacattcgcgagctgctggcacgcttgggccacgaggacatccacgaggtcatcatcgccaccaaccccaatattgagggcgagaccacggcgagctacctggctcgcactatcaagccgctgggcgttgaggtgtcgcgtctggcgagcggcctgcccgtgggcggcgacctggagtatgccgacgagcttacgcttgggcgcgccatcgaggcccgtcgcacgatttaggtggcgagcctgctcctgccgtatgttttcctcgcgacgcacggggtagtcataatttccccgtgcgactgtaagtttgttgtgcaacaaagatgctttgtatccgcttatcgcatggatgcttccactcgcatccttaatttgcccattcgttgcgcaaccttttgggttcgctgatacactcaaatatggattcgaatgaatgcgccgctcccgagcggcgtgtttttgttggaggagaacgcatgcggcccggtggcactcagacaaagcgcggcgccgcggtgcgcatgcgacgccgactgggcttggcgcctcgggcgtacgcgctgctgtcgtgctcgctggtgctggtcatagctggcgtttctgcctatggcatgaccgtgccgtccatgatacaggcacatgccgcatgcgaaccgcgcgtagggcatgaggtcaaaagtgatctgggcaccacgactggatatgcttgggcaagtgtggtcgcgcatattgtgtttggcgccgacgacgcggacggcgccgaggccccggacaacgaagtcacgcttgccaatggcaaaaccatcgtgctcaccaacaccaagatcatcgatctacgatgtctcagcgcgcgaaatcgatgtgtgtcgttgcgtgttatcgggcatggacaacgcggccatcgccgaagagctctccatcagcactggcaccgttaaaaagcatctggagaacatctttcgaaaaacgcgggtcaatagccgtgttgggcttatggcgctccttcagcagtacacggcgctcaaacagtaagcccgatctcgccccacgaaccccatcacgccctataaaacacgttgtcggcaaaaaagtcggcgggcggctccatacaggcaatctcgccgtcaaacatcatggcgatgtcgtcggctacctgctcggcaaaatccaggtcgtgcgttgccatgatgacggtgccgccagcccgcgcatggtcgcgcagggcgcgggcgatgatgcggcggctggccaggtccagacccttggtgggctcatcgagcaatagcagttcggggccgattagcagtagctttgctaacgcaagcagttggcgctgtccgcccgaaaggtcataggggtggcgttcccctaagcctgcgagccccagactcaccgcgcgctcccgcgctatatcctcgccgtacccgcaggtcgaagcccattccatcagctcgtcgcgcaccgtctcggcaaccagcaatgctttgggattctgaggcagcagcgccgccgaggccgctccgcgcatcatgcggccgcgctgcagcttggcggtcttcgccagcaccgaaagcattgtcgacttgccgcagccgttaccgccaacaaccgcatgcaccgcgccagccgagaactccgcatcgagtccgcgcagcacccaaccggacacgcggtcgtagcgaaaccagccccctgccagggtggtagctgacccggcgtgcatttttgggaatattcggcatccgccggcgcgcgatggcgcccccgagtcgttttgcggcaggatttgcacctcaaattcaaccgatttgcccgatttcagtcctttattcgcactcggagcggccgcgcgcggtcccaaagagctctgctggccaccggcgttgctgaaaattccgttttttgcacgccgcgagccaccccaccctggcacctcattcctgcagagccatcccaaggtacgcttcgtgagctatccgggcctggagggcgataagtactatgacatcgctcagaagtacatgcccaacggtacctgcggcgtcgtgagctttggctttaacggtggtcgcgcggcggccgagacctttatgaagagccttaaactcgcccagatcgccacgcatgtggccgatgctcgcacctgctgcctgcatcccgctaacgccacgcaccgtcagatgaacgatgaggnnnnnnnnnnnnnnnnnnnnnnnnnnnnnnnnnnnnnnnnnnnnnnnnnnnnnnnnnnnnnnnnnnnnnnnncggccgatctgattgccgaccttgagcaggcgctcgagcagtgctaggctagcttctcgtatgaagcgacggagcctcttggggttccggtgacatatagttccgattccgtaggcgggaccccaatcgcgactgttcgcaggcgattggggccccgtttttgcgttgcaccactcgaaaggatggatatggagaaaactgcagagcagctgcgccgcgagcacattgcccttgagggcgatacccatggcaagaacaaatgggcgattctgtttaccgtgctcatcatgacgtttatgtcgtgtctggattcgaccgtcgtgaccgtggcgttgcccgtgatgcaaaaggagctgggcgtgggcctcgatcgcattcagctggtaagctctgtgtatctgcttgcgacgtgcgtggctatgttgccgtttggccgtctgggcgacgtgcgcggcaaggtgaatgtgtttcagctgggcgtcaccgtcttttcggtcggttcgctgctgtgcggcctttcggcctcgctcgaggttcttatcctggcacgcattgttcagggcgtcggttgcgcggcggccatggctaacaacatgggtatcatcaccgagtcgtttccggcgcgcgagcgcggtcgtgccatgggtattctcgcgaccttcgtggccctcggcatgatgtgtggccccgtgctgggcggcatgctggtggcaagctttccctgggagagcatcttcctcatcaacctgcccattggcgtcatctcgtttatccgcgggctcttgcgggtgcgcttccggcggtcagcccggtatgtccgcgcaccccaccgcatttcgattctccgtccggcgctatcgtacgaatccagtcttttgtcgggcgcggcccgggggctgcccatcaaaaaggtcgtgaactcgcgccggcgatgcgtcgaggcgcgggccctcccggcgggagtcggttgtcgccggccgctagaggacggtcccctccgacctgcacccgatctcccagacccagcaggcgagctcgcgcgccacggcggcgttggccttgcacgcgctcttgcccgccgcggccagcgcctctcggcggcggtggagcctggcggtgcagtcgtccgccctcgagcgtatcgccgggggcacatcggtgccgggggctggggccttgggcctcggggagcacgtggagtagtgccatgcggactctatgagcgccgtgcgcgcgagcgcgttgccggccttggttatcccgccgcgccgctcggactcgccgctcgagtgctccgacggggtcagcccgcaccagctcgcgaaggccggcgccgagcggaacctgctgaaggacccggcctccgccgcgagcctgaaggccgtcagggtgtcgacccccttgatgcaggacagcgcctcctccgtcgcccgccagcggtcggtgcccgccagcgcgacgaccctcctctcgagctgccgcctgtccgattccgcgcagcgggcggccgtgacgtagtactccagcgcgtcgcgctgcggcccctcgagcctgatctccgagacccacctccagtgggccctcgtccaggccctcttcctcgccccgtcggcgttgcgctcgtcccagacgtggcccagcctgatcaggaacatgttgaggcgctgcctcgagcggcggagctcgcgggtcgcgtcgtcgagggcgcggtcgaggtcccgggcggcctcgaccgccacgtcgggcagcgggacctcgacgatgttgtgggtggcgagcatgcgggcgatgaactcggcgtcgcgccggtcgttcttgcgccgggcgtccgccgccggcctctgcatcctggagacggcggccacggcgccagctgcaagaccaaggcctggctatagcatcagcatcgtgctgcggcaccgagtttatgcgctgcacattgcaggcataccaaacgctaacgtatccgtgacatagtcgttggggactactccgtggtgtcgtcgtcctcggcgagttgggggaacacggcgttcttgggcatcgtgaccttcgtcagcgaggtgagctttttgctgagcgacgtgtccgtcttgaccaagtcgctcagcgtcacgatcttgtagccgtctgcaacgaggccgtcgataatctgcggcagtgcctcgagcgtctgctcggcgcactcatcgctatcggtaagcagcacgatattgcccggcgtcaccgagtcgagcaccgtcgagacctgttcgtcggcaccattgagcaaccagtcgcccgagtcgatattccacgagaccacggcagacaccaagtccatcgagtcaatccaattttgctcgtcaaaagcggcgtagggagcgcgcagcagcatcgtctttacaccggtcgcagacttaatggcatcggtgcccttcgagatctgcttgcgcaccgtctcgcgatcctcgcccttgagcgaatcatcgctatagctattggagccgacttcgcacccggcgtcgacaatcgccttagccgtggcgggcgaggcctcggcggcatcgcccgaaaggaagaacgtggcgctcacgcccttctccttgagcacctgcaaaatctgcttggtggcgccgctcggcccctcatcaaacgtcagcgccacgtacttttcgttgcccttgggcgccacgctggcgcaggcaaccacgcaatcggtcgcgggcacaacctcgccacggtcctgcgtcttgcccgattgctcgccgacccacacctcggagcgaccctggacgccccatgtctgcacatactcgatggcgcccgtgccctcgaccttcagtttgggctcgatggtcgtggcctgcacctcgtgcttctcatagatgttgcggccgtctttgaccgtcaccttctcgccgccggtaagctcgcggctgtcccatttgccctgctttacacgcttgccgtcaaccttcttcctgtttgccccgcctgagcagcaattcaggaactattccaccgcaacttccaagggacccgagcgaccctcctaccgttgcggtgaaatacggactgattggcggcttttctggtcaaaacagtccgtattccaccgcaagttattgaggttagaggttgtaggtgactacttggggctcggcgagctcggcgaagacagctggggccgtctgttccacgcgaacgaacttgaccgtcacggcctcaaagcccgccttgtgcagaacatccgaatagacgcgcgcttgcagggcgtgtttctctagcaactgatccggcgtnnnnnnnnnntccggcgtctcgtccggcgtgccacccgtcttgtagtcgatgaccagcgcacgcgacggattagcaggatcggtcgccagcgcatcgatagcgccctcggcatacgcaccgtagcgggcaatgtcctcgtcctcgcagcccagcgagaagaacggcacctcggcacgaacgcacggccaggcaagcagctcggcgcgaaccgatgacctgagccagcgattcagggcgacatcgaaacgctcgcgttgctccggcgtcagatgccacaggcgcgtcagtgcatcggcgcgctcggcaggcaattcgtcggcgcccatctcaatcagccactggcaggcggcatggaacgccgagcccagcgccatggggttgccggcgggctcagcggcggccacgtccgcgtccgtcatctccgagccatccgactccgcatcatcgccggcctcgtccatgggcacgcgcgcctcggcggcacggtcctcggcctcggcatgcagcgctgcggcaatcgacgaatagctgtacgaatcgcgcgctggatacgggcaggtacccatacgcacacccaccgcctggggatacacgagctcaaacgcatcgggctcggggtcggcaggactgggaacggcgacgcgagtacccgcatcaacaacctctgcctccgcatcaccgcggacaagccttccctcggcatccagcgaagcgttagcctcaaacgtctgctcgtcaaaggtaaagtttgccagcgatcaccccggcggcatgcgcgccgtcatcaaactcgatgcggcgcaggtcgagggcttggcaaaacaggccggcgaggactgctggccggtcaactacaacagcccccagcagacggttgtggccggagcgcccgatgcgttgcagaccctcgacgtcctggtaaaagaggctggtggccgcgctatgaaagtcgcggtgtcgggtgcattccatagcccctatatggccgaggcgacctgtggccttgctgcatatatcgatgccggtcacgcgccgtccccgttgctcattcccgttatggcaaatatgacggcggcgccctatccggccgacccgcaggcggcatcggaggtgctggccaaccaggtgagtcatgccgtgcgctgggtcgacacgctgcatgctctgcaggatcaaggcatcgacacgtttattgaggtcggccccggcaaaacgctgtccggcctggttaagcgtacgctgagcgatgttcgcgtgtattcgtgcgaaacggccgagcaggtcgcagctattgccgacgagctcgcatagcccacagggctgtaacccgaaaggaacgacatgggcaatttgaacaacggcgcgctcgagcgcgacgaatcgcgccgcgtggcgctggtcacgggcggctcgcgcggcatcggtcgcgcttgtgccgtgggcctggcggaggacggctttgatatcgccgtcgtctatgccggtagcgcagatgcggcgcgcgagacgtgcgaagcctgtgaggcggctggcgccacggcgcgcgcatatcaatgtgacgtggccgaccccgccgccgtcaacacttgcgtggagacggtcctcaacgactttggctccatttgggcgctcgtcaacaacgccggcatcacgcgagacggcctgctcatgcgtatgggcgacgatgccttcgaccgcgtgctcgatgtcaatctcaagggcacgttcaatacgacgcgcgcgctcaccaagacctttatgcgccagcgcggcggttgcgtcatcaacatgagctcggtcgtgggcctgatgggcaatgccgggcaggccaacctggtgctctcgcgcaccatgttcggcgtggtcgtggtcgacatcgccaacaagatgaaccccatcgcgggtgcccaggtcacactaacgtcgcgctatgccgcgggcaaacaactcaccgccacaaccgatgacgagggcacagcgatctttgaggttgccccactttcggaaggctacgtggacgaggcgacgctccttgacgcgtatgacttcaacggcggcatctccatcagcatgccgggctaccgcgatgtcgagatccctctcgcgcgcatccagggcggcactgccattaccgcgcccacacgcccgctctccgacggtgagccgtactttcgccagcttacgttcgatgagtgggacatccaatacgccaacgccacattcatggcaatgcccaaagacgatgtagcaaacgaacagcccgacgtgcatgcctttgccgtacaggcccacctgccgcagggtgggcaggcaacgctgcgcatcaacaaagtgacgcctgccgcgggcagctcacccgaaaccgtcacgcagattggccaggtcaaggccagtgcaacgggtgcggacaatctggcgacgttcacgctcgaagacaagttcctcgatgcggcatcgggcattctggaagaaggatgcaagctgcgctttgccctcgactatcaaggcaaaacctacacgctctcctcccccatggccgttgtcaccgcgccggccgcaaaggcggaatcgggctcgaccaccatcattcccaccaccatggatcaagagatcactccgtttgatttccctgcggcgtttcccggtatcggcggcaacaagttcacctgctggatgcccacgtttccaatcctcttcgatttctcatttgccgggtatgtgctgtttggcggaggatacaaaccagccagctatatgaacgattcgggcaaccctgatccggaatactggaagaagtcgccgcgcgaatcgggtgccaagcaggcaaaccgctacctcgacgagatggagggaaagtggaatcagtacaaaagtatgagtgccggttcgggcagatgcgctgtggctcaacgccaccgtcgagaatctgctcgccatcaccaagctcgagggcggcggtatgcgtctgtcgactacgctcgagctcatggacgatatcgtcgaggaggcgctgcgccacgtgaaccctgccgtgcgcgagcacgaccttaaggtggtggcgtgcgatgagccggcgctcgtcaacgtcgatgcgcgcctgatggtgcagctggtggtcaatctggtgaacaacgccatcacctatacgcccgcgggctcgcatatcatgatttcgattagcgtcgacgatggacgcgtggcgtgctcggtggccgacgatggtccgggcatcgcatccgaggaccgcgagcggatctttgagtcgttctataccgccaaccatggtctggctgacagccaccgcagcgttggcctgggtctttcgctctgccgttccattgcgttggcgcatggcggtagcatagaggttgccgcggcggacccgcacggttcggtctttacgattgaacttcccgccgccgacgtttcgtttgataaggagtagcgctgtgccgaactctgccgtaaaaccgctcatcttggtcgttgaggacgaccccgccgtccgcaacctcatcgttgccgcgctcgaggcgcatggcctgcgccatatggccgtggagactgcccatgccgctattgctgccgcctcgtcgcaggcgccgagcatcgtgctgctcgatctgggcctgcccgatatggacggcgtcaaggtggtggagtcggtgcgcacgtggtcgggcatgccgattatcgtggtctcggcgcgcagcgaggacgcagataagatccgtgcgctcgatgccggtgccgacgactacctgaccaagccgttttcggtcgaggagctgctcgcgcgcatccgcaccacactccgtcgcctttcgtatgcgcagataggtgcgggttcgtccgagggcacgttcgataccggcgagctgcatatcgactttgatgccggcatcgccacgatggatggcgaagaactgcacctgacgcctattaagcgccgtcttgttgagctgctccacctgcgtatacaggccgtagtcctcaaaggtatcgttggacttttcggtctggtcgcacacccacagatgcacaaactgcgtgcgcaggcccatcatctggggaatcccgcggataaggtcgtaggccatcttgttgcgaaaacgcataccctcgcccatgtgcttgttgagcgcaatcgcgcgctgttggcgccaggtgcccttgccttttttgagctccaccttgtaattcttttgcgtgtaggagctcgacgtctggccgcgcacctgcacggtggcattgggcgcttcctcgccatagccaacctcgccggccaccgggccgtcttcgtcgcccggctgcagcaggcccataacctgatagcgcgtcacgcccatgtcggcatagtcatacaccgagtacgtgttgatctcggcccagctgtggtcggtgttctcggagctgttgccgcgcgagaccgtcaggtacatggtcacaatgtccgagtcgtcgtagacctcgtacagctcgtccttatcgcgcagatgcttggactggtcggaggcctcggcctttttaatcttgtcctgcttttttaccttatttgtcgaggattcgtcctgagatgagcagcccgaaagcagcagcgcgccggtagccgcctcgatcagacagcggcgagacatcaacttatcgatcatcagaacctccccaatggttgcgatacacgcgaactactgcgcgctgaaacgcgccgtgcggcacgcccttgcggcggcactcctcatagcgctgctcggcacggtcgagcaagcggcccagctgtgtaaagcgacccgttttgtcggtcgccacaatgggctgctggctcaggatacgatacggcaagttggcggtataggtatcgagccgcagcagggccacgataaaaaacaccaccgcacccaacaaaaagccaaagccgtaaaactgctgcggcaaaagcaacgacacggcggtcgccagctctgccacaccggcaaatgctggtggacgaggcgctgggcatgctcacgtacttcgccgacccgtacagttcctggcagcgcggcagcaacgagaacaggaacggcaggatccgccgctatctgcccaagggaaccagtttcgaggatctcacgcaggacgagctcgacgcgatcgtcggggagatcaacgacacccccatgaaactcctcggatacaaaacgcccaacgaggtatgggacgaggagatggccaagctacaatcaaaacaagccgacccgaaaccagccgttgcacttacaagttgaatccggggcgtgcacgttcatcatccagttcgccatgtcctggcgcgatatcgtcgcgccgcacgccttgaggtctgtctctatgcggtagagcggcagcgacatgacgtacttgccgttgacgatccaggcaagcagcgacggcgtcgcaaacgagcctggtatcggcggctcaggctgcggtgctcgcacgatgacgcccttgcgttcctattgagtttcacttgagtttcaggggcgtttttggggtggtgggacaaactactgggacagttcactctccgaaaaatcctttactcttcgtccgctgcgtgtcgccatgtccgtggtgtacgcgcttttagagtaaaaatgactgaaactgcaggtcaaaaggcataaagagaccccctgaaaacgttgtttccagagggtctcaatagtttttactcacccaaaatcacaggtggctttacgctttttcgtacgtggcggcacactgcgacactctacggacggaatttcgattgcgcaaaatccgctccagtttactcccactcgccaaagtaaaactggttctaaacaatactgtttaggggatttgactcttagttgctcaatttgataccaattatccaacttatacggcgttgtcggactcctgttatcaaaagattatcaagcccaatgttatcagcagaaaagcccgttgtctaaatgaaagtgcaacacccgttagattggaaattgcctagaaaaccgatgttgacatgcttgcggtcgctgagcaccgacaccacgacccagccgccctcgggggtatagcgcatggcgttgctcaggaggttgatgacgcactgggtgatcatatcgggatcggcctcgacgacatcgtcatggccctgggtttcatccgcaaagcgcagacgcagatcgcggtcggcaaatagacgctcctgaccattcacgatcgaacgcacgaacggcaccatgtccaccggttcaagattgagcggcgcggtgctgttttccatacgcgacaggtcgagcatctgctgcaccagacgggccaggcggcgcgtctcggaggcaacggtctccaaatgctcatcgtcggtgggatacacgccatcctgcatggcctcgaccgttgcgagcatggccataagcggcgtgcgaagctcgtgtgcaacatctgaggtcaggcgcttctcgtgtttcatatccttctcgagcgaagtggccatctcatcgaaggtctcacccagctgatcaatctcgtcatcaccgcgcaaaccagtacgagcggacagatcgccatcgcgaatttgcttggccgtgctcgtaatacgatgaatcggcttggtgagcatgcgcgacacgagcgatccgataacgaccgaaatgcagatggccacaaccgcggcgagcgccatggcgttaaaggtcttctccctaaacgcagaatccgccttggtaagcagggcgtcggagccgattgcccacaatttgacctggcccacatgctcgccggaggacgttacgatctcgacgttggccacgctgtcggagtcggtgggggcggaggagaccgggctgtgcgatgccctcttgccactcgtgtcgtcggtcgttgcctgattttcgcgcacatcggcggtagcgctagccgaaggccacgagtcgtcgtagacgataacgccctttttattgacgacttgcatgccaagatcgtcggacaccaggctcgatgtcgcgaccgtgcgaagctcgcccgcggtccagttgcactttattggctccaacgccgacctgcccatcgtgggcggctcgatcttgtcgcacgaccacttccagggcggcgcgcacgagtttcccatgatgcatgccgccgaggtctcgcagtttagcgtgcccgggttcgaccaggtcaccggcaccgtgctgcagtggccgctttcggtgttgcgcctgcgctcgcacgatcgcgcccagctgctcgacgccgccgagaagatcatcctcgcttggcgcgagtggaccgacgagtccgtgggcgtcatcgcgcnnnnnnnnnngtggcccacaataccgtgacgcccgtcatccgccgcgtcgactcccgcggtaatgccggtggcgagatctacgaggcctacatggcgcttcgctgcaacatcacgaccgacgagcatccgctgggcgtgttccacccgcatgccgagtatcaccacattaagaaggaaaacattggcctgattgaggtcatgggcctggccattctgccgccgcgtctggttcccgagcttggcgccgtccgcgagcacctgctggcagccaaggtcgacgcgagctacgatcttgccgccgcgctcgagggcgacgacctttgccgcagccacgccgcgtgggcnnnnnnnnnnnnnnnnnnnnnnnnnnnnnnnngacgtttatgcccgtcgtgccgatgagctcacggcggataacgccatcgacatcctgcacgaggaggtcggtgtggtgtttggccatgtgctcgacaacgccggcgtctttaagtgggacgaggccggccgcgccgcccaacagcgcttcatcgactcgctgtagcacgcagcctcggacgcccacgctcgacaaatagcacccacacgacaacggcgcccgccggcaacatcgccgacgggcgccgttttctgatgcaagggtagctaatttgggacggggccattttgactacttttacattcaaagtagtcaaaatggccccgtcccaaattagctacctcccatgagagtggaaaatctccctaaacaacggtgtcgagggctattgtcccactcttggcggcggggttgagcgacaggtgcagttattgagcaatagcgtaaaggtcaaacccgccctgcggcgtgctatcgaccgtatcgggcgcctgtgaattaaaactcaccggaaccatgcgctttgaggcacggtaacgcgtgccgtcggtggcgacgggcggctcatcgaccgtgagctcgtagtcgccgggcttgagctcgatgccgtcaccttcggaattgacgtannnnnnnnnnnnnnnnnnnnnnnnngcgtgcgacccacgatatggacgagcatctggctgtcgccgcgcgcggtgtcccacgtcgcgccgtccttgacctcgaccgatacatgcaccgagcgcgtgcggctgagcgattgttcgacggacatctcgaccttggcggcgtcttttcgttgttgttcaacatggctccagacgtttccaattaccgagcatgcgataacgccggccatgaaggcgatgaggatggggccgagcggagagcgacggcccgcgtcctcctcgcgagccaggtcggggcgacgtgtgggcgcgggtgcttgggcaccctgcgagggcacgtcgagaatgctgaaggatgccgtactgccggggtcgatgttatggcgcggctgcgggatcttggccggcgagatggacatgtccgccggctcaccgagtgtggccgtggcatcggccttagcttcatcggcctcggcttgggcccaagcctgctcaaaggtcaggggctcggcggcatcggaggcggcgtcaggctcgacagcagcatcgttgccggcctcgtcctcgtcgctcgacacgtcacgcggcgcgggctcgtcccactcctcgtccggagcctcgccctcgctataccaccattcaaagttatcgatatccatacggggcgccccttaagcctcgcaaataaacacttgccagccttatacccccagatggcacgggagctcgccggcacag
